United States Patent 10,767,156 (POLYNUCLEOTIDES ENCODING BREX SYSTEM POLYPEPTIDES AND METHODS OF USING SAME) - sequence listing, part 2

SEQ ID NO: 1 - DNA, 3010111 bp, Lactobacillus rhamnosus (residues 1,505,057-3,010,111 of 3,010,111)
taataagtttggacgatttgcaaactaaaagcatccaacgtactgattttagccgcgtttaccatggcaatctggttggccagatggcgccgatcctcagcatttaactcatgtcgcttggcggtcagtgtttgcttcaaggcagtctgaatcttagtccgcatttccgaagttgccgctcgcgtaaaagtcacgatcaacattctggtaatatcggcgtgctgcttgagaatcttttgaataatccgttcaactaatacagtggtcttgccgctgccagccgaggctgataccaacatatcatggccgtgatggttaatagctgcttgttgcgatggggtaaattgcgtcatgactgtggatgctccttttcagaatgcggtatttgtgtcgggtcagcggtaaggcgtccaatcacgtctttacgctttaacttagggacgtgatggtaatgatcaaaaccggttgcagggtcaaacagcataatactttgatagtcgctgcgactgacaatcgtggaagactggccatattggaaaggctcaagtgcaatatcccccgcaagaatttgcgtggctgcatcgataatcagcgcctgattgtgagccaaataagcccgcaacgcctcgggagtcaggacgtttgactgattctggttgaaactgccatcttttttaaagccaagcggggcaatctcactacgaccgccactttccggtgaaatggtacgatccacggccgccagctcatctccgtgttcggcgactaagaaacccagatacttgaaggctttgagtcgctcaagtgccggttccaattcaggcgtgtatttgagtttaggatcctgcaagtgaaaatacagcgcccccgccggaacaaacggtggctctgccgtcacgttggtcattgcttcaatgtaagtcagcatttgcaaggcaatgccataataagcgtcactatcatcgaagcggcgttgcccacttttataatcgacaataataaaacgccgggcatcaggttcgcgataaatatcaagccgatcgattttaccgcgaacattgacgcgacccccatgcggcaacggccatgataagcctggcagtcccttggtatcgccaatccggccaaactgcagctcggtgcgcaccgggcggaagccgctgcgttgctgttgctggcgcatgttgagcaaaacctgaatgagcagtcgacttaagcgcttggtcaaataagtcatgcgatacgtactgccgaggatttcataccccggctgtttggcaatctcggcaaccatcggcggtacagcagtcataatcgccgcggggtcaacatcggccaagttttgttgttgatcacgcaaatgggttaaatatcgatcaagcacggcatgaaaaagactaccggtgtcggctggtgaaagctcaaattccgggcgcggttggagcagcaaaccatatttaaggaaatattcgaaatgattaagataatacgtctccaatcgcgacacggaaacattcatatcgcggccatagagttgcaccgccagctgtggatcaaggcggccaggatcattttgatacgtcaaacttccggcaaggcgttgggccaggttggctaaatcggtttgtttcaatgcgcttaacacactttgccaagccagactcaggggttgtttttgctgctgggcatcaccggcagcccgaatgaagtcgcttaacattgcccgcgggctgccaaggacagatttgaccgttgtcgcgagtgttaccggcgcccaggtttcgggcacgagatgaagcgcccgtttcagttgctgaaaataaggtgacgcctgattttcactattttcttgcgggttttgcatggggtaacttaacgtcaacgtctcgctggcggccataaaacccaaatagttgatgaacgggtcacctaaagttgttgttgggccttgctcgggtaaaaagcggtcatctggcaactgtgcagctaataattggcgctcttcactgtttaaaacgccgtcatcattaggaacatccggcatggcagtgctggtggccccaatgacaaaaatatgttttgctttggctaatcggactaacccggtttctgaaatcacgaccgcgtcaagtgtggcaggaatctgtgtgtaagtcgcactggcaaagccggcagcaagcaactcatgaaattgctcgcgattaaacttagcgttgcccaaaatggtaacgtaatcatccagcaaagcggtaaatgtggtccatgcttgttcgtgcgctcggctgcgagcaagttcaccggctgcacttgctgcttctcgccacgcgttcaactggtccactaccccggttttcgttaaccagtggtacaaacttcgcgcagcttcaagtccggttttagctgcctgccattgtttgagtaaggccggcacagtttgagccaccagcgtttttatggcattgatttgagcggttttatcggcttcaggatccatttccgtttcatcagcagcgggattacgctgaaaataccgccatggttctgtctgtgtccagcgttttttacctgcaatccccgttcgaaccaaatgattgtcgagggtatcgacggcatcgcgataatctgccaccgtcatctcctgcggcaacaaaagctcagtatgcaacaagcgcatgatgtcttgatactgatagtcatgatcctgaatggcaaataggctttcgatcaacactactaagggatgatccttcatcggccgctgcaagtcggtaaattggggaatctgaaattcagcaaaaatagccggaatgatcgttgcatacggatccaatcgccgcgcaagaatcacaaaatcccgataacgtgctccgttgcgaaccgcttgatagatagattgggccacatgccgcaattcctgatagggatcagtcgcagtggctaaacgcacctgatcggcaacatttgcgggtggcgtcggctgcggttcgatattggtattagcctgccaccaactcgccacccgtcgcatgcccaagcttaagtgccgcggctgagcaaactgatctagcctaatgggaacgcgcatcgttttggctttttgatacaaacgatgataaagtcgaccagctggtaaaaagagattaggagcaacaggcggtgtagttggataaggccgatccaacacgaggccgatcgtcacttctgcggcggtttccagcatcgtttccaccagtgctgactctgaagcagaaaatacgttaaaatggttgagatagataaacgtgtgggtgagatcatgggtacgcatggcttgctgcagcccacttagcagactggcggttgtcgcataaggaccgatttctgcttcatattgatcaagaataatgcctaaatcacgcaacttagcccggtgccgatcgcctggtgtcagagccgcaacggtattggctaaatcttcagcggtaatccggccaatcatgagttcactcaattgatcagcaagctgtgtgacaaaaccagtatgctgagcttctccggcatagatggttaagtccgcttgccgttctgcaagaatcttggcaaccaacatcgtattgttagcttgatccagccgcggttgctgataaagcggcgtgtttttcaaataaaaccaggccaaccgggaaaaggataagacctgaacgcgactttgcacgtaagtctccgagttcccctgttgcaattggcgcaagcgtttgagaagatcaatttctgcttcaaatttaatatggtttggtaccagtaaaaaaagccggttttgggaatcagcggtaagcttttcatgaatcatagccgccatggtttgggtatgatccgtcgttgcatcaccgagaataaactgcaaccccatgtgaaaacctcctaagaaaagtgagcgcgagccggcgcggttagaagtcggagtgtaagcggccttgggcgtgatggccgggctttggccattgcgaccaaggtccttacacgcagacttctgcgctggggagcgcgttatggtatgagcgcgagccagcccggttaaaacctaccccaacccgcatgttgcgatgtgagaaaaccactagcacagcagccccagtacaaagacgaccttaattttaatcgtcattctcttaaaccacctacttaaaggctaccgcaccaacaaaaacagtttcactatttaaatacgtgtgtctgatgacttatgctttagtctagcataactaagtagtgtccgatcagggtttgcgctattataagtaaagaatattaacgaggtgtttatatgaaaatcgggacggggaaaagttacgcaaaaattattctcattggcgagcacgccgttgtttatggggaaccggccatcgctttgccagtcaaaagtattcggttatctgctaaagtcgagccaatacctgatggccggcaggaagtcacgtccgccttttttaccggcgatttgaatgcgggtcagttaaccaattttgccggcattgccatgctcattcgccggctgctcgtgttcttcaatgctgctgatcaaggcttccatctgaccattaccagtgctttgccatcggaacgcggcatgggatcatccgcagcgactgcagtagccgttgtgcgcgccttttacgatgcgtttcaaacgtcgctcagccattcggttttgctaaactgggccgggatctcggaaaaagctttgcacggcaaccccagcggcttggatgcggctacggctagcgctgaaaagccgcagtggtttgtccgcggcaagtcgttacgatccatcatgatgccgcgcaatggcgttttactgattgccgacactgggatcgccggtcagacgaagattgcggttgatcaagtggctcagaaattaaaaaaggacccgaaaacgtatcagccactgattaccgatattggcgatgcggtgcgtcaggcggctttggcactggcacaagatgacattatcactctaggacaacttttaaatcgggatcaagcggacttggcggcccttggcgtcagcagtcctgaactcgatcgactgattaatgttgcccttgataacggcgcatatggggcgaaactgaccggttccggcatgggcggctgcatgattgcccttgccgccgcggaccaggcaccggcaattatccaggcactaaaggtagccaatgccgttaaagtctgggaataccactttgaaacgaaatgaggctgctatgacaacttatgcacgcgcgcacactaacattgcattgatcaaatattggggcaaagcaaataagcaattgatgctgccggcaaccagcagtatttcgcttactctaaatgacttttacacggacacggcggtaacttttgaccctgaactcaatcaggatcaattgacgttgaatcaccaaatgcagtcgcctactgctgtcagccgctttttggatcatgttcggcacctggcccaaattgatacacgcgctcgggtcacctcattgaatcatgtaccgactgctgccggtttggccagttcggcttctgcgtttgcggcgctggcattggctgcaagtcgcgcggctggcctaaatttaacccctaccgccttgtcacggttggcacgtcgcggttcaggatcagccactcgttcaatctttggcggagcggtgatttggcaccgtggcagcgatgatcaatcctcgtttgccgaacccctaaccattcagccaacgctgccgctgcggatgttggtcgtcacggtttctgatcagaaaaaggcagtcagctcccgcacaggcatggccaacacggttgcgaccagcccttattaccaggcatgggtgcaatcgaatgaagcgttaatttcacctatgatcacggcactggccgaaaatgatctgacgacgattggtgcactcaccgaattatcgagtatgcgcatgcacgccgccattatggctgaggagccgccgttcacctactttttgccggaaactttacgcgcctggcaattggtgcaagaacagcgggcactcggcattccggcgtttgccacgatggatgccggacccaacgtcaagatcctcacaaccgcaccgtacgtggatgttctcatgaccgccttgcagcctgtttttggcgaccggattttgagcacccgcctcggcccggacgcgcaagtgattacaaaggagcaatttaatgacacagagtcagcaatcacatcgcaaggatgagcacgtctttttagcggaaaaatattttcaggcgactgcgcatgccggcttcgatcaagttcggctactacaccgggcacttccggaatcctcattagcagatgttgacttgacgcctcccattccttttggctggcgttggccgatttacattaatgcgatgacaggaggttccccgcaaaccggcaagctcaatgctcagctagggcaattagctcaggcgcttgatctggcaattgctagcggctctcaatccgtggccttacatgatcctcaattggcccctacttttaaaacgctgcgtgatcataatccggatggttttattcttgccaatatcggtgccggacacgatcagcacgcagctgaaaaggcaattagtatgttagacgcggatgcacttgaaattcacgtcaatgcggcacaagaagtgatcatgccagaaggtgatcgcgactttttgtggcaggaaaatatccgtaccattgcagcaactgcttcggttccggttgtggttaaggaagtaggtaacggcttcatccgcgaagatctgcaaaccttgcagcaactaggcattcattatgtcgatatcggcgggcgcggcggcacgaactttgcggtcatcgaaaatgctcgccgcccccaccacgacttttcctacctgcaggattgggggcaaacaaccgttgagtcactgcttgaagcccgcggactaccgttaacaatcctggcaaccggtggcattcgatcgccgctggatgtcattaaggcacaacgcttgggggcgcatgcggtgggcatcagtggactggtgctgcaccacttgattcaaactgactatgcggctacattagcctactttcaggaattcctgcaacaattacggcaactgtatgcattgctaggcgtgaccaactggcaagcactgcaaacggcaccggctgtgctcagtcctgaattagaatattatcgccatgtccgtcacttgccagcaatttgattttaggtcaataacaaaaggatgctagtaaacagacaatacctagcctgtcactaacatcctttttgattactttttaagatgctgatactaaattgcaagccaactaaactcgcagcccttttggatagaaattcttaaccgttccattgactaacttgccgattgcaaacggcttatgttcaaacgtgagtaagacgaatcgtttccctgacagcgaggtcgtgagcgtttcgccatgacggtagcgcgcataaccatcggcatccacctcaatcacggtttgaaagtcagatggatctagcgcagttgcgatgctgtggctaggttcaaaccggtttttacggaaacttccaagttcaagccccgcgcgaaccaccttcacgcgatcaaacggtatcatggttttcgggagtaacgacaggaagtccccgtggcggtaaaattgtccggtcaacggcttacgcaagctggtcgagaaaaaagtggtcacttcatcccgcgcggctttcactaaaggttttatctttagcggttttactggttcgttcggcaattcacccgcaagtcgcagtttggcaacgaaatggccttcaccgcgtacgagatgtggaaacagccgcactgtttttgccaattcaggattgccatctgcccattccggtcgaccggcaaccattcctggagactttttaatgggttcgagcgtcaaatcgtagtgagcaagcagccaggcaatgatttgttcgtcttcttccggactgaacgtgcaggttgaataaatcaaacttccgcctggccgcagcattttaattgcagcttgcagaatgacttcttgtcgtgccgcacattctgccggatagtcacggtgccaatactgaatcgcatctggatctttgcgaaacattccttcaccggagcaaggcgcatcgaccaaaatccgatcgaatgtctgcggccaggctgcggctaatgtatccggatcattattggtcactaaaatattccgacttccccaacgttcgagattaccggaaaggaccttcgaccgcggcccgtttatttcattgctgaccagtaacccggtttcaccaagataactagccaattgcgtggatttaccaccaggagcggcacatagatccaacacccgttcccctttttgcggtgccgcgactgtcccgacaaattgcgcactgggttcttggctataaaccagcccggaaacgtgatcaatcccgtttccggcaactttgccataatacccccacggactccaaggaatgggatccgtggtcttttcgtctaatggccaaggtttagccggatcgcgccggaatcccgccaatggttcgtcatcaaaactagccaaaaaagccgaggcgtccgctcctaataactgggtatatttttctttaaatgcttcaggaagttgcacttgttcgatcctttctccgaatcaaatatcgcaggaaaacaacagtcgcaatcgttaaaataattaagaaaccccagatgctggcgcgggtcgtatagtaaaaccaccaattggcaaacaaaccgccaagcagcaaactgatgccaacgtggctggcacagctcgacaagacgccgcgcaaataccgcgcacgcatgttgatttctagtcctgatgtctgcaagggtccgatgagcaccaccattaggacgctcagcaaaccggcccccaacaataagagcacacagaataaagctgtctgtccgtaagcgcgccaccaagttgcggcattgctatcactaaaatgaacccgatgaaccttattggcgcgcagaatacttttaagcactttaccatgctgatttgcaccgtcaacatagacttttacctgcttgaggcgtaatccaccgtttgcggtattgggtgacgcattaagaaataccgccttgttcagcggactacccttacgcgtgcccacagttcccaccactggaacatattgatcattcacgctcaaataacgctgattattgctgccagtgtagagtttatccgctaagtcgtgaccgacaaccgtaaccggtaaacttgattcaaaatcgccattcgaaaaccattgaccagtttcaaccggcaagctcgcaaccgttccacgctgatacacgtagaccacttgcttactcacaaactgcacttgataccccgaaaagtcagtctttgccagttccgcaaccgcagtcgtcacctgccgctgactcttcgtcacatattcttgggcagtctcagacataccaagatgatccagctgactggcatattcattttgatcatgctgcgaccacaccaacccagccaaaattgccaagccgatccatagtaagtcgattaagaatagtttcttcacagtggcctccttaggaaaagtgagcgcgagccggcgcggtttgaagtcggagtgtaagtggccacagacgtgatggccggtctttggccattgcggctgtggtccttacacgcagacttctgcgccggggagcgcgttatggtgagcgcgagccggcgccttattgaaagtgagtccacacactaaaaccaactccgctcatcacatcaaccgatacacccgttcatgaattgcatcaaaatgacccagtgcgcgattcaatgcaaagattcggcgatcaggtaccatcatcgcctcctgccaaaataaccggctattggtcgcaccatagcgctcgccaatcacaaacaattgcttatcaggaaagtatcgttgcatgatatgtaaaaaccgcacatcattggggtctttatctgggctccatgccatgaccaccgcatcaacttgtgccgcatataaaaataaagctgcattggcggtagcggttttcactggcactaatggttggcggccggtgacattttccgcaacccatgtatgagcatcggtggtaatagtcggatttccttgatcacgtaatcctgcactgacatagccattgcccgctgcgacttccagataacgttgacggccatacaactgttgccatgtcgcgaaaaaatctttatgcacaaacgaccacataccatcatgaaacgcaatgtaccgcctaaaattgtgaagcagatgatccaacgccatcaaatcggccaatttggctcccggcagtaacaatgcctgttcaatttgaggggtggttaaccccagccacggcaaggcatgttgcggtaattgctggttggcaagcgcaagccgccacgctgtcatggctgcgatttgtttttttaacggtgaaattgcctgatatttttcagccagttgtaagagtcgtgtccagtaagccatcctaacctcatattctaaatactggcagctacttagctaacccttttttcgcgcaaaagaacaggcaaaagccgccatgaacggcggcttttgcaacaggggcaacaacctcgtactaatgaatgcccagtgccatcttagcataccgactaagacgttccgggccccacgctgggtaccagacaaggtgaatctcaacgctttggatcccgtcaatcgccgttaacgcctgtttgatatcggcatcaagcatatcggttaacgggcaacccatggtggtaagggtcatttcaaccgtacatttaccattttcatccaagtcaaccccatagatgaggccaaggttaatcagatcgatccccaactccggatcaatcacggtttccaatgcatccaggatctgctgtttcattttatcaaaataggcctggtcttgggtggcggcttgatcatgcgtatctgccatcagcagtcccttcctttctgaacgtcttaatggttactttttgtccgcttcaagcacgccagcaactgaataatggttcttggccatttcattcaggacaatatggacatgctcagccggcgctccggtgtccttaacaatggcggcggtaacatctttgaccagtgctttaagctgctccggcgaccggccttcaatcaaatcaatatggactagtggcatcatgctccactccttcaactgagaataaggtacgtgttaatctgctttattttagcatgtgaaacacgtttacgcacgtatgatcaaaaagtaagcgcgagccggcgcggttaggaatcggagtataagtggccttgggcgtgatggccgggctttggccattgcgaccaaggtccttatacgcagattcctgcgccggggagcgcgttatgggcgtaaaggcgaactagtggcctcaggtgtgatggcccggttctggccattgcgcctgaggtccttacacgcagacttctgcgccgggaagcgcgttatgggcataaaggcgagcgcaaacaaaatcaattagcagtcaaggtacatagcttcaagcgtgatagtccgtatttagccactgcaaataagatcgcacaatcaatccccttctctaaactcaagattcttccctttctttaaagtctcacacagtaaacaaattagtcgcctgctgcttcacccactgttgatcagcagtgagaacgatgatgtatccatgtgcctttaaccatgctaggatagcctgtccgcgcgccatgtcaaccacatcgaatgggcggtcaagaatcagcagctggctgctaagtgcggcccgtgccaacgcaattcgttgcttttcgccagtcgagattgttgaagcattgatttgggtgtcagtgtggaaccgcgcggaaataccaaggatgtccagtaagtctttttctactgaacgcgatttggcaactggtgttgtcccaaatgcaaaaccggggaataaatggatgttattcgccaaagactcatggaagacagctggattttcaggaagataacctaccgcaaagtcgggcgatttaaaattggcagccgccaaattcagatatttggcaggttcatttgccagttcgcgaagtaatctgcttttgccactgccattttgcccttctatacatagaatatccccaccacgtaaaacgaccgagctattcttaaattgctttttaagccggtcacgagtctggttatacccagcatcatcccgccctttacgctggaaaaattgcgcgattttagcttcaacaaagcggatgcgctgaagcaattcaagggtttgatttgagatcgtcacaaagtcaaatcctggcgcgatataagttaggaataaggcaatggttcccggagaaatctccttagtctgattcgcaatcaatagcgtgaatgcaatcgccagcatgttaataaaagcaatcatattggtcaaaaatgccgcatatgtcgcctgcttcagaccactgacgagttgttgcttattcttgcgatccagctcggcttcggggtgaagtacccccaagaagcgcatataccggttgttggaaataagatcaaacatgaaattaaaatagttaagcgatgcctttctagcacgcccatacaggacaccattgtatttttgagcaattaaaataacggtttgtacaactatgagtgggatgatgaccgcaaccgtcaacgtttgactgtatgaaaacagaatgaccaaagaacccaccaagaaggcaaatttcacgcacaagtcggtgatggtcaaggcaacaaagtcaattgacggcaaatcaacattcacgacattcagaaggtcggcggcatgcttcgacccaaaatcaggcagttttgcaaataatttattgataaaggttttatcggtattaaacgtgattcgcgcgtcaagcatgccatagcgttgacgcgacaggttgatcaggatgacaaccccaatgaacaccagaatcgtcagccagaacagcgacccgtgatgttttgccaaagcatcaaaggcccgcttttgaatcaggccaatgaccagcggcgcacattcctgtatcaacgaaaataggatcaaggcggcaatcagctttttattgtcgaaaaatagatcgcgaatttttaacattttgttcttcctcgtaggttgatgcccaatctgctagtttcgagaagtagacgcattcaccctttgtgatgccatagacatgatcggcaaaatgtagccggttggttttatgcgaaatcaggatcattttaaccttgaaagtgtccacgtaatgccgcagcaaacgggaaacctcggcaaatcgagccgtatcaagtgagctcagggtttcgtcaaggataatcaagtccttttctagcaaaagcgctcttaatatcagtagcagctggcgatccccatccgctaacttgtcaatgttctcaccggcttcacccacctgagctgataaggttgtgcgcagataatctagcctagctttcgacacaccaagttgtttgagccgttgccagacattttgcgtggcattatttgccgaaaaaccttgtaagttcttctcaattgaaacgtggaaaagcgattggtcaacagagacgtaagcaacgttcgctcccatttcagaagctgatatttttgaaattggcgtctttgaatagtcaatttgcccctcgtactggtgctgcaggccaacgatcgcttttgcaagggtacttttccccgaaccggacacaccggacaccccaatgatttgtcccggtgcaatggccatatcgactttctttagtaccaggtgatcaaaatttcttaagtttgaaatatggagctgaatagtaggtttagtaggatagggactgtttcctgattgcatcacaaatttgcgctccaattcagcaaggttggcaaatgcacctttgagatattgcacattattcgcgtgaaactgcatgctttccaaaggtgcttgaattctggtagcgtaatcgatcatcatatacaccgtccccaacccgatcacgccgcgtaggaaactgtacccgcccagtgctaacgaggtaacttccaaaaaggcaatcagcacaagtgcggcgatccacgaacgataaataaagctctgagcatgtaattccaaaggcagcagcttatcgtactgtttattaaaccaagcaatgacgcgattcgaagcctgcatcggggccacgtcattgttattaacaaaaacatcttgcagaaaatcagccgtctttgcttcccttcttcgcaacttagggatcacatcgttgccactggtattaacgtgccttaaaacgagaatcgagagaagcagataaccagtaaaagctgccccgatcaagactgactgaaaaaacaagacgcaaataatcgtgatcacctgaatcacatctgaccacactggaattaaggtttgctggcaaaaaagtcggcactgatcaatgtccttagtcaggcggtcatttaagtcgccggtttgaaaggattcagaatcgcgaatttcatcaccaaaggaaattaagttgaggtatccttttcgtacccggtgcgtcattttcaaaaaaaccacatacgaaaaagcgctgaagactgtgcgaccggctaacaatatcaaccctagtgctagataaatataaaaattgtgaagaacgtttgcgctgccgggaactgtcacgccgttgatcatgcgctgaacaaagacttcagcgtatactgcactggcactcaacgccaaagatattaataagaccagtcctaatgtcagcttaccgcggcttgaagcaatttcggatttaagtattttaggcataagcgcttccttgttattagtatgaaatcttaactatcggcgagccgttaaaccggatggtatccttcattcttaatggcttttaatattaacaaccatccattgcgtatgtaggatagcagtcgcctggtgatctcattttattatcatcaggctatcattatattgtgaaacggtcaactaatgatctgataagcaatgtattttttttgaattcatcaccggatcacggctttgcaggcttgattttcacgacaacaaaatagagccgtccaaccacctcaactcatcaacgccgcttctgcttaaagtgcgcggaattaatgggtcagtcgataattagacgactctcttgactacaaaaatgttagccgttacataaacgtaaacggatcggtcgacaacttcgatggaattgccttgacgtcccaaccctcagcaaccgcccattcgttgatcaacccggcaactttttctttcatgatcgcttcgatgtgatgcccagggtcgatcacaggtaaatccgctgccagcatatcgtgagccgtgtgatagtaaacatcgccggtaatgaagacatcggcaccagcctctttggcatcgttgaaggcatcgccgccatcgccgccaagaattgcaacttttcgaaccggccgctccaagtcacgagcaacgacgcgtaagcctttgacgtgatacgctgctttgacttgttcaacgaaaacctcgaggcgaactgattcaggcaataagccgattcggcccatattcgcaccttcaccttcgttaataaacggcacgacttgagtcaaacccagcgcatcggccagccaatcattcatgccttcctgaacccgatccaaattggtatgggcgctataaactaacaggtcatcttttaaaatctgcgcgtacatcgcattttgcggaacccgtaagtccagattgtgaaccgaatgaaacattgctgggtgatgggaaaagatcatgtcagcatgaaccgtttcagcctcggccaccacctcgggacgaacgtctaaggtcaccaacacggttttaacgggacgatcagggttgcctaattgtaagccactgggatcgcgctccatagcaaggcttaaaggcgcatagtcttcaaaacgattgataatatctttaccggttgtcatgtgcacttaattcctccttaattaatgccagcaggtgctcctgttcacgaatcttggccaatggtaccatcttcgcatcggctaatccttcaagtaccgcttcggttttttcggcttcacggtgcatctttttcatgaaagtcggatttttttgacggcgcagaatcggaccaaagcgcaggtctgcttctgagtaaggtacatcgggtctggttttgcctgctgccatcatttcgtaaatatggccttcatcttctataatttgttcaccgataatgccataaccgtgtttatctagccatagtcgaacatcgtactggtgacgattaggtgccagtaccagcgtctcggtgccatccaactgcggctgaccggcctcgaggatgttcgtaatgagctggccacccattccggcaatcacaatagttgaaatggcatcagcagggtgaatgccggctaacccatctgcttggcggacgctgatttggtctgtcaaaccagcgtccgcgacattttgcttggcaattgcaacgggtccggcgccaatgtcactggcaacggcgaatttaatgatgccgcgttgcacaaggtcaatcggtaagaaagcatgatccgtgccaatgtcggctaagcgctcgtttggttcgataaacgcgcgaatcgcctgtagccgttttgataaatgtatatgatccatgaatttactgtcccctcatctgattaacagcttttattataacaaactgatgtcacgatgctggtattgtcgctaaaaaggttcagattcttgttgtgtgccggttgtgtttcaaaatagcatctgaccggccgcgccaagtcgcaaaaagccgccatctcaaatgagacagcggctttgtcagttgcttattcaagaaaatccttaagctgcttggaacggcttgggtggcggagtttccgcaatgccttggcttcaatctgacgaatgcgttcacgggtcacgccaaagactttgccgacttcttccagcgtgcgcgtccggccatcgtcaagtccaaagcgcagccgcaaaacattttcttcgcggtcagtcaaagtgtcaagcacgctctccaactgttccttgagcaattcgtaggaagcgtgatcttccggactggtagcgtcttggtcttcaatgaagtcgccgaggtgtgaatcgtcctcttcaccgattggcgtttccaaggacactggctcttgggcgatcttcaaaatttcgcggactttttcggttggcatatccatctcggcaccgatttcctcaggagttggttcgcggccaagatcctgaagcagttgacgttgaatccgaatcagtttattaatggtttcaaccatatgaacaggaattcgaatcgtccgggcttggtcagcaatcgcgcgggtgatcgcctgccgaatccaccaggtggcgtaggtggagaacttgaaccctttgcggtaatcaaacttctcgaccgccttcatcaagcccatgttaccttcctgaatcaaatccagaaactgcatgccacgaccaacatagcgcttagcaatggagaccaccagtcgtaagttagcttcggccagtcgttgcttggcttcttgatcgccttgttcgatcttcaaagcaagggcaacttcttcgtcagcggtcagcaatgaaacccggccgatttccttaagatacatccgcactgggtcattaatcttaaccccagatggcgcggacatatcgctcatttccttcttggaaaccttcttttgcttcttgaggctgatcgttgccggttcgccattttcgtcaacaatcgcgatcccattgtcttcgattttctgcattaaatcatcaatggcggtactctttagctcaaacggcttgatcaatttagaggttaaatcgtcttcggtgatctgctttttcttcttataatctttgatgacagctttgacggcatcatcataagccttagtcgttgtgtgactcttgctagcggtagtcttcttggccgttgttttcttggttgcggtctttttggtcgcagcctttgcttcggttgctgctttggttgaagctgcagccgttgtcttctttgtggtcttgcttacttcagttgctgtttttttatcagccattaaagttcctcccctagccttgttgttgcttcaaaagtttcatgagattcacatattgcaccgttaattcgccttgtttctgtttgtcacccaatcgctgtgcctcggtaatggcttgtttaatcgcctgcagccgcgaaacggttgacgccgatgtgatcgtctggattaactcatcaatcgtggcctcgcttgcttccggcagtgactgcatcgcgacatcagccgccaccccgctgagctcaggattaacccgatccaaaaatcctgcaagctcaccatccggctgttcatgcaaaaagcgcaaccaaccagtgaaaagtgtttgaaaatacggcgttggaaatacaaaagtcgcatttttcaagcgttgcatcacgaggtcatcgtgccagacatagtacaataactggcgctgagccgcggtgtagcgatccagcgggcggacgggttgatcggcaaccggtggctgagctgcggccggtcgcctggtttgcggactcggcaggctttgattgagcgcggcaatgggcacctcggtcgtctctgccagctgtttgacgtaaaccgcccgagcaaccggatcactgattttgccaatgatgcgtaaggccgcattcagataagtcaacttggcctgatcgttgtgcatgtccacaccacgggccagaaattgtaacataaaagcagttggtgtcaaaaccgacttgacttgtgcttgaaaggcttctgctccccgtgcacgaatgtactcatccggatccatgccatccggtaaaacgaccacatccgtttgcaggcgaggatgatcagccagcatggtgacagcccgttcaatcgctttttgacccggttcatcaccatcgtaacaaactgttaaccgtttgctcaaatgactgatgatatcgacttgttccgtggtcaaactggttcccattgaagcgatcccggttttaacaccagcttgatacgccgcaatcacatccatatacccttcaaaaaggatcgggccaccatcacgcccaaactcggctttggcgcgatgaaggttaaataaaatatcccgcttgttgaaaagcttggtttccggactgtttaaatacttagcctgggacttatctaactgtaaaatccgcccggaaaagccgaccaccttgccattagcatccgttaacggaaacatcacccgatcattgaaacgatcaaacaacttaccggcctgatcttcaacaaataggccactggcgcgctgatcctgatattcaacatggcgattattaagaaatgccaccaatagatttcgttcttcaggtgcataacccagttggaattcttcaatcgtttcgtcggttaacccgcgtttatgcaggtaggccagtgcagcctcacctttttccgtatttactaggatatgatgataaagatcagcagtatcctgaagaatgtgctgctgcttggcaacttcaggatcaaccggtgctgcctgacccacttggacgtcaagcggaataccggcaaaatcggctacctttttaactgcctcaggaaaggtcgcgttgtcataatccatgacaaacttgaaaacattaccgccacgtccgcacgaaaaacaatgaaaaatctgtttggattcattaacggaaaaagacggtgtgtgctcttcgtgaaaaggacagaggccaaacagattctgtccagtctttcgcaactgcacgtattgcccaatgtaatcggcaatattgaccgcttttaagacttgatcaatagtggcctcaggaatcattccggcgatatcagctcactcccttcccatggcgaatggcattgcaatcattgcgccaccacgacttgaaccgattgaaatagcggtaaaaagtcgcacttctgacgtgaaatgcgacttttatatagtctatcggcataataatgcaagatatagtatagcctgatgaatcaagaaaagcaagtctatttgacaatcacttggctaacgtcaccaaattggcggattaacttagcaagctgctgcaaggtagcaaggcgattttcgcgaacagtcttatcatctgccatcaccatcgtcgcatcaaagtaggcatcaatcggcttagccaaggcttttaatgcttgataatccgcttcagtcggttcagcagcaaatgttttggcagttgttgtcactgcgtcatgtagttgaccttcagtcgggttttcaaacttagtcggatcaaccgctgtcgttaccgtttgcttaccggtaatccgtaagacccgccccaaggcttccattaccggcttgaaatcagaatcggctgcatgctgggtcagtagcttagcagcagccaaaataccggcaatatcggcatcgctgcgaacagtgacggcatcaacgatatcatgccgaatcttttgaccttgcaacaactgcttggcccgatcaatcatgaaatcgttaagttcttgttggtgcgcggcaaaatcaagtccgttcgtttgatcagcttcagccaaggctttagcaatggtcggctgtaggctagccagcgcaaacggccagtcatgttcggcaatcatgcgcacaataccgtatgcctgacgccgcaacgcatatggatcgttggaaccactcgggattaagtcaacggcaaagaaactcatcagcgaatccagcttatcggcaattgccagcaccgttccgactagactttgcggtaaggcaccgtctgccgcgattggttcataatgttccgcaattgcttgagcaacagcaggtttttcgccggcaagccgggcataatgttcgcccataatcccttgtaattcaggaaattcgccgaccatcgacgtgacaagatcgaatttgtagatcgaagcagcgcgatccagatcagctttttcgtccgcggtcaagccgaattgatcagcaagtaacgcggcaatgactttggtgcgcgccattttgtcgtacattgagctgattttgtcatggaaactaaccgctttaaggcgctcaacgtcttcagcaatgctgcgtttctggtcttcggcatagaagaacgctgcgtcttccaagcgcgccgttagcactttttcgttgcccgcaatcacattgttcaaatgatcgtggttgccgttacgcacgccaataaacgcattgaccattttgcctgcctgatcacgagcatagaagtaacgctggttatctttcattgacgtaatcagcactgcttccggaattgccagatatttcggatcaaacgtaccggcaaaagctgtcggccattctactaaattgttaacttcttccaataagtcactatcgagttcgatctgccattgatgatcggtggcaatttgctcgatttgttcccgaatcaactgtttgcgtgcagccggttctacaatcacaaactggtctttcaacgccgcaacataagcatcggcattaggcagcgtcactggcttaccgaggaatcggtgcccttgggtgacccgccctgcttcaacatccaataacttcatcggcacaacggtatcatctagcagactcactaaccaatgaatcggacgaatgtactcaaaatcatatgctccccatttcattcgcgtcgggaacgttaggcttttaatgacatcaagcatgccaggcaaaatttcggcagcatccttacctttaatcgccttatgcagataaacataatcaacgcctttaatcgtcttaaacacgatgtcatccggtgtcatcccttgaccacgggaaaatccgatggcagctttggtccaattaccatccgcatcttgagcgattttcttggccggacctttaacatcggtttcaacgtctgcctgtttagcggctaaatcgtgcaccagcagcgcaagccgacgcggggttgcgtaccggtcaatttggccatgctcaaggtgattggctttcaaaaaggcaacggttttgtcgtgaaattggttaatacttggcgtgacaacatgggccggcatgtcttcaaggccaatttcaatcagatagtcatgcgtcatgttattgcacctccgttttgtgctgcagcaatgggaaaccaagcttcttacgttccgcaacgaaagcgcgcgcaactttatgcgccattttgcggatgcgactcatataaccggcacgttcggtcaccgaaaccgccccacgcgcatccagcaggttaaacgtatggctgcatttaagaatgtaatcataagccgggtgaaccaaccccagatccatcaagcgccacgcttctttttcataagcgtcaaaaaacttcagcagcatagcttgatcgctgacttcaaacgcgtatttactgtgttcgtattcaggttctttgaaaatatcgccatataaaacgccatcgccccattcaagatcaaagacactgttcacgtcttggatataggaagctaaccgttcaacgccataggtaatttcgctggtcaccggcgaaacttcaagaccgccaaccacttgaaaatacgtgaattgactgacttccatgccgtcaagccaaacttcccagccaaccccagcacagcccatggatggattttcccagttatcttcaacaaagcggatatcgtgttccaacgggttaatgccaagtgccgccagtgaatccaaatagtaatcctgaatgttttctggcgatggcttcatgacaacctggaactgatggtgctggaaaagtcggttcggattctcgccataacgaccgtcagctgggcggcgtgacggctcaacgtaagcagcattccaaggctccggtccgattgcccgcaaaaaagtatacggactcatagtaccggctcctttttcaacatcataagcttgcatcaacatacaacccttatcgccccagaatttttgaagcgtctggatcatcgtttggatgtccatttttgtcgtcatgattacctctttcccggtgaatcaaagtctggcgtgggtagatgaatgtccatatacatgaaaacgtccctacgccaagatatggcgtagggacgcttctgcgcggttccaccctacttcagatagaccgaatctacctgcagctttgtcatttggttcgaaaacgccaatcacattcaccaccatcaggcttacactatccctgactcgcttgggtttggtacaaatgcgaccctttttctcatcaccgattcaatttcaaaccaattttaccatgagcattcgagctgtcaatagattttctgaaaacacctaattgcaagcacttttgccatgttttccctcatgttatctctcatgttttccctgtcgtctgtaccccttgtgccagtggagctacagcagttattttttaccggtttttaaatactctgccagcttctctgcggcctccacttcttgttcctgatggacacgggcatagatttgcaaggtgattctggggtcggtatgtccgaccatcttttggaccgtactgacagcgacaccggcaatcaaaagattagagatatagcttttacgaaacttatgcaacgatataaccggtgccaagttgttgttacgaataatggtactaagccacatgcgcggtttatcaacacgaaaacggttgcctgtcttagtagtgaacagaagttggtgatgagttgaaagcctgacatagccatatacatagtcaggttgttcaattcgccatcgctttagccaattaatagtttctgaatcaactgggacatcgcgcctacttgctctggtttttggcggattaacaatcagctttccatgcacaccgagtgaaacagttttgttgacactaattagtcgctttttgaaatcaatgtcttcccattcaagcgccatagcctcgccaattcttaaaccggcataagctaggatacgaaacagcacgtacttgtaaagttccctatcagggttaatacaattgaaaaatacttccaattgacgtctatcccagaagtcgtttgtggagccaattttgtcttgaacacgtggcaagatgatgcgtcttgcaggattgtgtgtgatatagtccctcagttcagcataggtaagtattcggttgatatgaacaaagtaccgtttaaatgccactggagactgtttaaaccatttattcaccgcagtttggacatcttgtggggtgatcttatcaatgtacatgtcacctagatcaggcaaaatatggagattgaaacagtcacgagtcttggaccatgaactttccctgactgtgagcttgtatgattttagccattcttcatagacatccttaaactttcttgcaactttaacagggttaggtgcaaccgtgagttcaccattctgaacagctttctccaaattacgccctgctttaatagcgtcttgtcgtgtgagcttacctccttttacaacatacttcttacgtccagtctttggatcaattccaacataaacggataccttccaccgtctttttccactatcaagtttgtaactcctgattgaagccataattttgtcccttcatcgccagcaggctatgtagagggctaactatttacgctgatcaacaagagttttagcaataactttaataagttctacctcagtaggcctaagaagcgttccttcccattgaaatctagtatttgcatccgacaactcagctagaagagttgcctgagcaggttgttcattaaggggtttaatacgcttgaatgctagagaaattttggactcggctgccttagtgatactacgtgtgccgtgctcatatgaattgattgatccaactgataaccccacctcttttgctaattctccctgtgtaagtcctctatcaattcttccttggtgaacttcttttgctgtcattaccacagtactcacctcttctcagcctaaatgaatattttaaacattttgtagttgacaatattcaaatcatgggctatgcttctcttgtagttaaataataacactttgtatgtggctattctacatagtaagggaagtgagaataatcgtttattttgtgtcttggctaattatgcatcaaatcacacttgcagctttatgctttgcaactttagcaggaatctttattggtgctctgattcaatttcttgaagacaacaaaaaagctaccccgcacgccaatgcgaagtagcctatagctaacttaatagccgaaacaatcaacccacgtcaatgggtcgatatacttatcccctagaaaggacaaaataagtgtatcatgattgttatgttcgtgccacagcatacctgcgcacggttgaaataaagtcaggtggtcagctagagccgatgctataaagtccagccggtaagaaatcccagtcaggttccctatcgtcaaattcttggtgtctacggccttccggactttaaatggtaaatggtaggggtggaacgtcttgacagctttaactagctgtgaggtcatccagccatgtgtattagcggtgttttcaggagttagaccgcacagttaatagctaaataaatctcaaactcatgcacatggtactctgggcaggactagagtggtaactggatgctggttattagcaacgtgattatcatgggctaataactaggctgtgtatgcaattggtggtgaagagccactcacagtcactttttgtggcaagggggaactatcagcaattcaaatattcaaaggcttgaaatattaaaaacagccaccaagagttacgataatctgtgtatatttaaagccttcattttgtcttgaacattcaagaacaacgtagtagtcatcatcattctctgccattaccacaatgccctgagatttctcagaaatccatagtggttctttaccaaaaaatttacttacatagtcatttgtaggagcaatatcaaagccattatctttcaaccatttatgccaatccaatattgccggtagatcaaacattcttgcagcctctagtatacttatttgttcttctgattctttctccaagttgatgacatatttcttggtagcatctagtgcatagccatgaggagaaacaagttgacccataccccggtttaatttcagcttttccataaaaaacctcctaattattttcagtatcagattgatctctctagatgattttgtcaactttaaagttatgaaaaaacaactattgttgcccaacaaaaaaagccccctaccatgactagtatagggctaaaaggtgataaatgttggtacaaggttaaagtaccatatgtgtagtgtttgtcaatagttgttacctgatgtacaggctttcgcccggatagatcaggctgtagattgacttgccattgttagcggccaatgtgtacatgttgacgccatacttgctggcaatgctccagaagctgtcaccagagcggactgtgtaataagtgtgactcggtgcactatagttgctagaacgtgaaccatagctttctccacccataacacctaggcatatataatgatacctgccagagtagctaagataccgtgcccatacatacccattgtggatgtacacatggtcatacatgaggctttcaccgggtgcataggtaccaattgaggcatagcttgtgtcatcaccagtgcgaatgttaagtgtcacagaaggcctaaatatgccattctgggcgtaatctgtatcactagatgtaacttgtgaaggtgtagaaggcactgtggtcgcttgtgctggctgtttagagtaaccattatcggttatacccagcaagtcaacattgccatctaggccacctacagcgtgcatgctggtaaattgccagatagctacaccggggaggcttggaaagtaactgtatagtggcaatactcggatttggtagtcaggataaccagcaacccaaatggaattaggaaactggctaagtactcgattgtagtcaacgtgggctactatgtaaggcttgtaactgtagagcatcggggtataacctgcttgggcaatccgttgcatcccataaataatggcatcagtgttagcctcaacagactcactcgccccatcctcgtaatcaagtgccacaattgatccctttggtgtctgaatacgtggcaggaaataatcaagtgcttggcgaccaatatcagaactaccaccaacaccataccataggtaactatggactctaagcccgtcatcattagccgctttgatttggctactataagttgactggttataaattgtaccgccttgggttccaccaatttgtgaaatagcaaaacggtcacactcaactgtcttgcccttgttgccttgatacactgaccagtcaacaccaatatcattcttggccgctttaacatgggtcggtaaggcaaatgaaaaggcagccataatggctacccctgtgagtactagtttagttttaaattgcaatcttaagcccccttaggataggttgcttcaatggtgttctttaggtcgctataggccttctcaactgcattttcaatggtctgctgatcaaccttggtaaatcccatggctttcaattgagtttcaacagaagctactgcttgcgatttcttaacggcccctgttattgcctgagtaacacctaactgttcggctgcggtaacagctgcttgtgctaatggttccaacacttgcaccaatgtcaaagcctgtttattcgctaataggacctttgccacccatgcacccaaaataggtatcactgcaatagcaatttggacaattaaatctttcatttttacccctcctcacaagaacttttcgatgatatacacaaatagggtgactccaatcgtcccaccaagtacgccccagattgaccacaccattttctttagactgctaatgtctctggcattatcttggctggcattgtatgccttatcggccttgtcatctgtacttggtaggccagttaattgttgcttaatctgggcaatatcttccttgatctccattagcatttttgtttgttcgtccacaatttcaccccataaaaatagccgctagcttttgccaccgacatagtccttgcctgtaatttgcttgtattgatctggtgtaatcattaccggtacataaggtgttagatcaattccccaactgtaaagtagtgcacactgatcataattagtcacttgatttcgccgccttcagctgtgctacttcaagagttaaatttgcgagtagcttctgttctgcggtcggtgtcacttgattagccgctttgtctaatgctgcttgtttatcggtatctatgacaacagtaccgtcatcagccagctttgaggcgccaatggcaatctttttcagctcttcaggagcgatcagaatggctttctcatcatcgaatggcgtttgccactgagtgccgtcccaaaattcctgctggtagccagtgatatagccatcttcatcagtgctaaaaatggcttttactttgtcaacttccatagcaacctcctaaactgcgtatacctcagtcataaccgctttagctggatatcctgttgcgttttcaccattgccaacaatatgcctatcgtcataaaacaaaagtttgtaggttgtaccaacttctctcattgtgagagttacccgcaaatagttagccccagttgtgttgtataccagtgcagcctttggtatgagagtgaaggcatagttgttatgcgttggcacgccattttgaaaataactccaagcaatgagccagccggttagtgtttgagacagtggaaccgacattgtcgcaacgtctctattctcgggcatcatagccccctgccaaaccatctggttattatttgctaattgcaagacttttacagtgtctaaagtgcttgagatataggttgcactttttcccagtccactagctaagtgtgtaaactcaagagtccccattgagattctgctaacatccatcttcgttgtaccgtcagtttgtgttatatatgacagtaagccatcggggtttaactcagtatgatatctttgaccatttggattacccttagtatcttcaattgtgccatcaatggtgtatgaagtgccattcagagccagcttgccagttgacaatatgtttccaccttcaataggagcatgagtgaaaggcacgtttattgttggagaattaatttctgcgctgtcaacctcaattgattgcaactttttgatattcaacactgcttgctgaatgctctgatcgacccattttgagccgtcgtaatactgcaatgctgtggcatcgttaagcgttttcccgtgccaccacaggtcgcctttcttggggcttgtgggtgttcccaactgaatgtacgtgtatggcacatccttgcttccgggaaccccttgtggcccttgtggtccctgtggaccttgcggaccagtttcaccttgtgggccctgcactagttgccaagaataaagtgctggattggtgctgtcagcttgcgtaaagtctgtataactaccaatgtacttacgagaacccggagtatccagcgaaaagttcgttctaccatcactgctatcggcgtatgcgatatggaagtacggtgtcttgccatcagcacccggtttccctggcaccccatctttaccatccgcaccgtctgcacctttgatcagcgaccagttatagtcgcttggattcgtactgtcgccagatgtgaagtcactgtagaagccaatgtacttgcggttaggatcagtgattgagaagtcggtctggccgtcttggctgtttgcgtaagcaaagtgagcgtaggaagtacgaccatcagcacccggtttccccggcaagccttgatcgccttgcggtccttgatcacctttgtcacctttaaaaagcgcccagttgtaatcagctggattggtgctatcggcctgtgtgaagtcgctataggtgccaatatacttttttccatcgccaccggataccgtgaacccacttttgccacttacatcatctgcccaagcggtgtgaaaatagcttgtacggccatctgcaccctttgcaccgggaacaccatcagcaccatcagcgcccttaatcaatgcccacttaccagcgtaatctgatggatcatcgcttgggactgatgtcttgttagaccaaacgattgccatatactttttaccggcaggtaaagcgctcatattggtgcccttatcatcatcagcgtaacgaacccatggatatttttctgtttgctttgccaaaccgttaatcattgcaacaattcttgggtcaagatcggattcgagcaagctgtagttaccaaaaacagcagtatcactgtttggcactgtgtaatgatttttgacttctaacacacgggcgcttaaataaactggcggatgatagttgtggtgagcaatttgcacataatccccaatatcggccttaatatcaacaacatctgcttcgtaactttcttttggcgtattgacagattttaattgagtaatcgtccggttaagcaattcgtttgggttgcttgtatcgtagctgtagttaccaacaagataacctttggttgccgatctgttttgaggatcaaaagcgcctagacgagcccatgtttttcctgccacgcgatcataaaccactttgtcacctcgagggctaaaaaatcggccgtcatcataggcaatatcagcaaatgtaattggttcttgctcttgacctgtatcagtagttgatgtaggcgtactaccatatcctgccatggcagtgtgcaacgaatcaattgtgccgctggtctttagcgccgatagattgactgcatccacaaatcgctgttgcgtctttccattgccaatctccttataggcattgacaacttgttcggtaatggtcgatccatccatcttgaccacaaactcaagctctgctccatcaaactcatttgcaatatcgccaatgcgcttcaacttggtatcttcttggccatcaaatgacaaagttcttgtgagcgtcgtaatctcattaacgcctaatgtccagcctgtatcggccaatagttcattggcgtagtaagcaaaatcgtgagcctccttgtaggtaactttgtctgcctgctcattaatgagatccatcccgatgtctgcagcgttccacgtttgtatatagtcatcgccatcgtgagcaattaacgtgcaaagctttgtttggccgtatttgtttatataagcgatgtagcctcccaccgcaagctttttggcatcagggtgagtattgtctacagtaaaagtgtatgaagacagtgcgacattattagtcaggacaatatcttcggtatcgttgtaaatcggcaaactatttcttgcatcagttgaaggcgcgcagaggacatgctgatcgcgcgataaaatgaaccattgcatctatatcacaaccacccttcacgaagctctgtagacactgctggcaaatttgcccacggacttactactattcctaatgttgactgtcctggcggcgcaagcaatggctgtgagccaatgtcgacacgatcccagtcggtgtactgattgattgtcaataaattggttgatgagtctagcgtgacaatatctcccgctttaaagtagttaggcaagtctttgtacaagtcgacatagtccttctcaaaattccactcaatcaacccaaagtagtgtggaagtggcaaatctgcccattgtaagaagttaaacgaaacatacattaccttcgtgtctgctaattcttcgcaagtatacgtttgtgcggttccgccggcttcaccaccccatgcaaaaataaattgactgccagactttctgatatagcaatggcctgtgaatcccggagtattgctaaaatcttcctcatgtacctttgtgccattcaaatcataacggacagtaaagtccgatgttgtttgtgacatatcagaatagagaatccttgccatagcatttttgcttgcatcatatatcgtcatgcaaatttgtccaacttgacgtgtatcacttggggaatccaatgacagagctcctaatcctgcgtgcattcgcagaatacaattgactgctcccacttcgccgtttgaatcagcgggcagtttatagattaacgaaggcccatgaggcccatgattatttgggccaaaatcagatggcgtggtgatacccaactggtttgtcgggtctggtttaattgtgacggtccctgtttgtgtcatcacgccctgatcagcaggtatcacggcaaaagaagggtcgttcagtatatatttgtcaattgttggtcgtgtcttaacaagcatttgagaatcatcgtaggttttcccgtttacttccttcgtattgcctacttgataatatctgccattaagtgtcagccctaaaaaaccgtcatctgaagaaaatttgctcgttactttaacagggaccggtactgttccgctatttgtaactgtgatggtgtcggaatagtattcaggatccgctgggttaggtgaccacggagaagcagtatcgtttttctctaatttgatattgtcaatacatatccaaccacctccagcatatgttttaacgaagccaaaacgataatttgtgactgtaatatcgctgtctgcggtcatcgtggcagaaaactgatgccatgtgtcttggccgccgtcagtgtctctattgccgtgacccatcgacaggccccaaattggggacaaaccgttcgttgtcaaatagtctgacgcttgtccagttgctgaacctgcggccgcatatttgtaactataggtccatgtttccccagctttgatagtaactggcgttggtagcggaaaaacgatgtattgatcggggtcgatagatgaatcactgctttggttctcaatccgaagcatataagttccaaacggcgtgggatatgaaggcatagctggattaacttcagcggttctgtcatcgtcactgcttgtcccccaaacaatccctgatggtgttttacctgattcgaatccagaatctgtcagcatgttcactggcacgtccttgtatggcgtgttgtcagccgtctgcgtggctaccgagtgcgcaatgccaccatcgggacagacgaagctgattgagattgtccctgatcgaaagccttcagtgaaggtaggctgactgtctacgatggcaagataatatttatcaggctcatccccaaagattagctgctggggttcatccgcatcaatagcagcggccaaggaacgtctcaatggcaccaaatcgtcattcataacgatcccagttaccacaatcgtcttgacgtcgcgtgacatgtattgcagcatctggccatcgctaataccaaccttttgcattgtgttgacgtgattagttcctacatcacgttcgaccatctgtacatacatccactgggtaatatctactccggcgtatgtgattttaatgcctgcttgcttcaattaaacggttcctcctttccaataagcattgaacctgtctcttctgtcgttgtactgcttaacttttggtgcaacttttggataaaactggtcgtcaccaacttgcagaacaaagctaagtttcgtgagaagatcagcaatattgtccagcttctttcctaaatcatctgtaccgctgctttcgctttcagcaaccgcaccattacccaagttgtgattgatgttggtaacagcctgtcccaatagttgccaagcacggctcgttttagttaacggcagaattgtttctggaccatcttcgccaacaagcgcatggattggctgtgtgatcaagccaccattagcgtaaccttcagggccactgacacgagcaaaagcagagcttccagagccataaatggccttcatgtagtgaataccggcaagcagatcgtcatatccgttataaacatcgttgtggccggggaacttatacgcattgaacgttggcccaatggtttgtacaagccccattgaaggtatgccggctttagcgttgctatcccacaggttaattgccctaggattaccatttgattcacgctggataactcgcatccatgcagcaacttgataatcactggcatcaaaaccattggcctttaaagcttgaataacatatggcttccaacgttgcacgcctgaaccaccgggattagcacctagtgtgtcttgcaactttgccagttcttttttaaaccaatcaacaacactgcctgtcaatttgttaataacaccactggctaagttgctaaacatttcaacaccgccggaaatgccgctaatacttgacttgattaaatcggttacttttccaatagggttagcaagccaatcaccaacggcttccaacttgtcccaagcaccagaaaagaatttgccaacaccgccaatgacaccacctaagtcatagtgttcaacgccagccatattcatgatggctttggtttctttcccattaaagacacgggtgccttctggtaatagtcctgtggcattacgctgttgactcataccgatttgtccatttggtagctggtaaagttctttccaatcaggtccagtaccatcgttgaccatgacaaggtgcatcttttgggtgacagtaccaccagtggcaaagtgaacaggtgatagttttctcagggcgtctttgccagtgaacttctcccaaacccagttgataccgctaatagcaccattgataacgttgataactgcattcatgccatttgctgcagcatctttaatgccatcccatatgttgccgaagaaagacttgaggcctgaccacagggaacgccatccggaatctattttgctgttgccatcacttatccaaccgtggactgttgacatcccattttgagcgtttttcccaacatttccccagaacccgttccaatttttagaagtgtctgaccagaagctatcccaacctttgtggatactggtattggcattatcaatccctgactttgtgctattcataccgttctgagcatttttaacagtatctgaccaaaagttgttccaacctttgcttgcattactccaaaagctgtcccaatctttctttatctgcttattagcggcatcttgttgcttttgctgttgctgttgtgcatttgaatttttcttatttacatcattccaaaatccagtccagcccttaccaacatcgttccaaaatccattccagtctttttgcgcctgcttattggccgcttcttgctgcttttgctgtttcttttgtgccgcatctgttgacttgttgatgccatcccaccatttgactacattgttagtcatttgacgagcatcccagccaaggccacctagccaactatcagctggcttttttttagcattccagccatctgtaaactttttagcggcatcgccggcccatttaccggccactttgccaattgtggcaccaattgcggcgcctaatgggccaccaaaaaaagcaccgatgccaccgccaatcagcgtcccggcagattcaccaacggaagaaaacttttggccgacagtacctcctttagaaaaggcctttgttaaatccttaatatctgaaatggcatcataggcaattgtgatagtcgccatgcccttgccaagcgcactgctgtttagtttgcttaaattcgtttttatcatgtcagcgaatttcgagttagctagtttcttaagcccagaatacatgcctccaacgcttttggtgaaacccgtgatggcagcaattggtaatactttaccggccaaattcaaagcaataaatccagcagctaaatcgccaaaaagtttaggatgtttatcggcaaaatctcccaaagactttagcaatggattaaggaccttcagtcctgatgtgagtgccgcccatgatattttagccatagctgatccagtggttgaaatcgtagtgaagaatgttttaatttgaccagcgtggctagcaattgattgactaacttttgtaacagcatccgaaagcttgtccatcattttgtccattgctttaggcccagcagatagatcaaacgcttttgcgaaagcagatgtgattgtgcttaggcctttgctcattgcttgacctaatttgccaaactctttatcggtgtttttgtcctgtgaccatcggctgatagccccaagcactgggttttgagccgttaaaaaaggcttttctatgtcgccaattagcgctgggatgcgagacttgataacccgagtcatgccggggatagtttgcatcaagttgtctgacgctttgctatatttctgccctaattcttcgataacgttagtggcgtcttgagcactgattttgcccgcactcatctgtgcacgaagatcagtcatagttagctgagaattgtgctgaaccttcttctcgtattccagcattgcatcagccatcattggaaacgcatcagttaactgattgaagtcgccaagctggacaatagatccagatagtgtatgtgtgaagtcaagaccgacctgttgaatacgatcactggataatccaatcgcatcacccattgtcagaaaggcggaagttaaagcttcggttttgggttggttatcaaagacatgataaaactgctggtttagttcgtttaccaaatcagtatcttgaccaaacttgacggcaagtttgttagtcatgtcaaccattgcttgccctttttcagcattaccagttaaggttagccaaatggcattcatttgatcttgctgcttttcgtattccataccagcagcagttgcttcttcaatttttccttttagcgtttgccagccgctcgtaatggcgttggtgattaagccaccctcaacaattttgtgaagcaaacccggtgtcttttctgcttgcttgtttgttcccgatatagcttccttaactctgttgaaaacagacggattagccttgtccatttcagcttgcaaaccggtcatagaagacttggcttttgctaaactggtagccgtttcatcaacacgcgtcttctgtgttcgccatgcgtctgaatccttgccactagcactggcaatcttgtccaactcagcagactgtttagacaactgttcattcagattggcaatggaggacttatagccttccattttggctttgttggcttcttgctgattgccttcagcctctaagcgagtaacataggcttgatttgcccgtgcagctgctgtgtattcttgctgtaagccagctaatccagacttttgatagtccatggcctgtttggcacggtcttgctgagcttgcatactggccagttgcttgttagcgccatcgatttgctgctgatactttaaaaactgttgagcaacatcggcagtattacccttcaactcagcttgtttggctttgagagcgtcaatcttagactgctgtgcttcaatagacttacccaagccgtcatacttggcttgagcagcgccaactgcatcaccagcggatttcatctccgcctcttgagctttccaagcattttggctagaacgaacaaccgctgttaatgatttgacggattcgcttgccgacaatagatcaagggcaatcttggtgctcattgttgcattaatttgttgtgccacttcaatcaccctttctcttggtattgcttccacataattgccggatcaactggccggtctttcttatccttggcggacatcatttccagcatttcaaaataatcagcatcatcaaaatcctgcattgaccagtggaaatacatgactgcctgctttttcatccatctaaagtcctgtagctgattttcaagctcataaacttttacggctggattaatctttgcttttgctggcatcctgcttcttggcagctaagtcaatatcctcatcactcatgcccatcatgcgctcaaaagtgtaattaactgcctgaatagtgtcggcaaattctaaatccccaagtttttcgatttcttgcttgttcaggcctaaaaccgtggtcaagaagtcgattgagtcatgcagcatatcgcgttgcattttaataatttctaccggttccatatcagcaacatcgtctgccttggccatcagtaactgtaagtcatacatcttttccatgttccgattactggtcttgacttcatgtacacggttgctaagttgactaactttaattttcatttgtaataccatcctctgtattttgtaaggtcgctgtggtgaatcggacaccaccaagatcaccagaaagcgacttttgagcataaaaaatagcgcacgttcgtgagccattcatcagttgttgctatgaaattgtgtcagattgcgtctgtcatcattgcttagctggagttgtagtgccagatcctgttgaacttgccggcaatacgtaaccgccgaacacttctttgtacatgttggctttatcaaacttaggatcaatatcgctataaatcttgtacggctgattgttaaaggccatagtagtaagtgctgtgtaagtcaaagtgtcatctacacgttgttctgctgccgcatcagtctgaatgttagctgcggtttcggtcatgatgccatcaccaaagccgtaatagacaaagtgtaaacggtcaatggtttgggtggtaataagtaaagctacatgagcctttaaattctcatccgtataaccgcccttgctgtcactaacaaaacccttgatttgctgcttaattgcaaagtccaagttgttaatatctagagctactgatggctctgaagtaccaacagtaacgtcctggacgttgttgttgccataagtcttagcaatggtgcctgctaagttagtaatgttggcagttttagcacctaaatctttgtgatcgacagtatagataccgtctgtgcctaatcctgctccagtaccagaaattaacttttgttgtgcatcaaccaaagctaactggatttgatataaacctactgttgccatttaaattcctccaatgttctttgttctactgaaataaaatgtgttaaaaagttgctgtgtgtcttggtctaatgttcgttgtctaaccgcggctacctgccaatgttgatgagtaaaagccttcatcatggctatctcaatggtttcgggatcagaatcaagcaattgcgagtaccaaatctgtacttctacttcctgatttaatgcccagaaatcgttgtcaccatatgcagctggatcattagcagcatcagtaatcaatacaactgtttcgttcagattatcgactaattcttgcggcaagttattgcctttaactgcattgatattggcaatcccggcttggctaagcattgctactgcatcatctacagcgctcatttgtctccaccaccattcaacttggcgataattgcttcatatttctcggcttcagcggcaaatacagcatctttggcatcatcacgagcattatcaacaaaatggtcaccgtgaattttctttgtcccatcattaaggaaacgtgcaacaaatgctttattgccaaatccagcaacggaattaccattgtgctctttatcaatatcaccagtggcggagctaatatcttcactcagatgcccatacttgccaccgctacctttagtgtctgggtgtttttctttggttgcttcttgtagcttgccagcaaatacatcagcaccagccttggtaatcttctcttggtcgctaatagacaattcggcagcttttgatacttgcttaagccattcttcaagtgcatcatccatatccacggttatgcccccttagttgtttttatgagggttaagtagtcatagcgaatagcgttgtttgaatcatctgggctaatatctgaaatgtcatacacgatgccatcaaggcgtgcctgtttctgctcaatatttcttgcatcgtgacgaacaataatcgtgattgagttatccaagcgtgtgcccacaagcgtgtactgctgtgttaaagttctcttttgctgtttgaaatgcagactgtaggctggcacaaagctagtgatattaaggccagcaccagtcgtgtgtgattttggagagccaagctcaatggttcgactaaagtcacttggtttaaagctacttaccattgttgtcaccaccactactagcctgtaggtgtgccagcatcatcagaagacccttaggcataccattggataaaccacggtcataatatgtagcttgtgtgagcgttttgatggctggaattgtcaaggtatcactatctggtgcatcacttgatctattaatgatattgattgcagtgtttaccagactaataattgttggcaattcagactcatcaaggtttaactcactcattaagtcactagcaatcttgtttggatctattgttgcttctgccatctgtacacctccattcggccgccgcttagaatcaagctactattccttttttaggcgaccagtttacttagttatttgccagaggtagtagtaggtactgtagcaactggtgcagtataggtaatgaacttaccagcagctgtatcagcagctttaaagtctgcccgcagtgctgccaaaagtacctgttcaaaattctcattacgttgccaagacaggttaatgttgcccttaacagtttcaaccacaaagtttttaacactcccaatgaatgcctttgcgtctccagacttgccaagcacatcatcagcaacaactaccagcggagcaccgaacaattgtttgccggatggagaagtgatggaatcttgtaacaggtacctaccttcagcatccttctgcttatcaattgcggcaaagaatgattcagatacaacaaacattcggtcagtgtagttgctcaagccaacgttgaatgcatccttaatatcgtcaatgcttgcagcggcaactggagtagctgtttgcaatactgcaccaatcttgtgctgttcagtttggtccttaatgtcattaatgtactgggtcagtaaactggtgatatttggatagtcttgtgtcatttcaagggaaattggcagtgaaccacgcaaagtctgaacatcataattgacctgtgttaaagaggcatttgcaagtttagggttgtcagccaattcagctgctgaaaccagttgtgcagaagccttagacaaaacaggaatcttaccagtcggtgcagaaacttgaactttagttacatagccgcctaattgtgctgggtccttaggctgactcataatgtccaatacttggctaggcaatactgcttcgccagcgttgctatcaaaacctgtggaatctctcttaatttcgccagtcttcaaaaattccttaaaatcacgtacttcttcatcttcaactttgtctgctgttaaattctttgacatatcttttgctccatctcttttattttcttgcttgacatcttgttccgcagttacctcagccggcttatcatcacgcttttcagtttcagctgtttcttgctcaggctttttctcatccaaaacaacattactgtcatcatctgggacatcatcgtccatttgtgatggcgcttgttggtctgccaattgctgacttaatgactgaatagcagcttgaagtgttgctatcatgctgaccaaatcaccagaagttggttgagcagtagtttcatcgcttgccatatctggtgtagcgtcacgcttttcttcctcaggcttgtcaataacaacctttgtttttacttgtgcttttaaatctgataactgctgttgtaattgttcaattgaccgcttttggtcatcaacagattgttcttctttttcctctggcttttctgccatcttcacaacttctttcttacttgataaaaattgagccaaatcccgttgcacttgcacacttgtttcggtatatgctgggataggagtcagcgacagttcaaacacttggtcaattttgttaattgtgtggatcgtgttgccttgtgagttgactgaccaactatctccaccaggcgcaatcttaaaaccgaacgacatgcccttgatattgccattcagtatgtttgtgtatgtgtcatgccccaactgtgtgtctggtaactgggcattaaagtgtaaaccatcaggctgaatgcttgtttgtaatgttccagcgtctgcacgggccaaaatgttagaaaaatcatgtgcataaagtagcaaaacttggctcaaatcgacgttatttagggcattttggtcaacatattcggtaaaatcgcctttaatcgatggctgattgaacgctgccgcaacgcctgaaatatccatattttgtccattttcagcctgattgttgctattttcattggctaagcccgtttcagctcgaattttaacgtcaaatgtacgtatatcttcattttccactaaatcacaccccttttcgctagcatttgttgggcttgcaaaggcgtgatggctggtgttgtgccacttagcaacttctgtatctggctaataagtaggtcattatcggcatccacagcgctagattcatcaatattcacggggacgccaaatttggcacccatttcgctttctattggctttacatatcgccttaaagtgttgctataaagcgatttagtcatatctaatgaactttgctggtcaccttgaccattcaaatagctatctggaacaccaaaaaccttgcctatctgtgtcttggaccagtcattgcttgttagaaacttgcttacgtcagcattaattgataaattttgtacatcataaagctggtcaagcaccataggccgtccagcattgtcacccgtgttggcattttcaaaagcttttcgtgttgcttctttttcttctggtgataaagcaccctcagcgactttaatgacggtgcttggattaatagcgttcttaatggttgatagtgtcaacttgtttgcataatcttgaatgttgacttggcttgcaattgattctaatgggctaataccaatgtattgctgaccattgctaccactagccatcaatcgaaagtgaagcatgtttgcactcggataattgatagtgcctctctcgtctccccagttaaccgcatagctaatatctgcactgctgtctgccaaagtgactactacctgtgccgccggtgccatctctagcctcataggaacattgttgctgtctcttgtaatggcgatataggcgtttcccgtaagcaacatctgaactacagctgattgccaaaagttaaacggagaaataaggttgttcgggttatttatcaccttgtcaaagggtgcagccacttcaaaacttgccgatgcaatatcactgcttagaaggttggtaacagcatatagatcagaattatttaaggccgtactggcatcaaccaaatgattgggtaatacttgtccaccgcttatgatgtaacttgacaggttagttgatggtatcgtcatacttcttttctgcattcgttcatacggattccatatgctcatctactaccacctgccttagatgtaggcgtgagtagccaaccgcaaaagagcaatacactgcctagtaccaacgttcctatggtgctattaaaaagataagcactggtgacaatagcaattaagccggatacaaataacactgttggcaacagttccttaagcattatcaatttgctcacactcgcacctccctcagattctttgtgtctttcattgtttttttacctctcactatatatacgtacttgatgcgccatttttgaccaatatttaccttccaatgcaaaaaaatatgtagccttttaaaaagctgcattcattaggaacttatggcgctcttcatcactcataccagacaatggggaacggttcttatcattatctgcatctgggtcgaagtctgaaaaggcataataggcacggctaaatgcatcaataactgcatcaacagcatcaatttttgaagttgcacgatccttatctacctttatgccagcgcttgagccaactataaccgcattggtcaatgcatactttaaaattgggtcatcgtcataatgaactcggccttcccgaattgctttcttgaactcatgtgttggtttatctaacttatctgacgtctgttttaaaggcatcagtggaaatggttcttcttggcttaacttatccaaaacatcgctagttccccagcggtcaaatacaaagaacttaacatttaagccattctcttctatatagctcataatccacgtggtaacactgtcttcatctatgtagccaaagcgtccttttgcaatagtggcaaaacccaattgctcagcttgacgataattaattccatcttgcttttctttttcggcaatacttccacctgtgtgagataagggtacccaactatgctgttggatataatagtgtgtctctccagccaactggtatggataaatgaaagcaactgctgtgtcgtctgcaagtttgcttaagtcgaatcctatataaacatcatgaccagaaatgctgaatggtggcttatcagctactgcattttcgatgtcatgtatgtttaaatagcgattatcagaagccttaatccacatgttcaggttcttgttcttgaattcatctaatgttccgtccagctttttcttgtctcgttctgaaactaaactaggcaacatcgtatcctttttcaattcaagaattgggtttgattttgtccatgaggatgggtcatcaacttcatcttcactatcctgactgtagttaattagcaacacatcgtctaaatctcgtgaataatccttttgcattgcttctcgtgccaacttttcatctagataaaaactgctggtgctgtcagggtaggctgtcgagatagaccaaaactggtgatcatatacttgcacctgcccacttgtaatcttgccaatgttttctttaatggtgccaatccggccgtcatcaccactctcatcagccacagcaagccgaaaatggtagctatcaaattgaccagactcatgtgacaaacggagcaactggtttcgcgtctttttacttctaacgacatcatccaaagtctttatctgctgggttttatatgttctctttacatctgtaagttcacctaatctgtcaaaggtaagttgaatgtaccgccatcctttttttgattgtgcaaccacaggtgctatatatcccatgtcttggttgtacatgccatcagatgcaatcaggtagtcatatgcaagtagaatatttgtgatgtatgtcttcccatttgttcgtgccacagaaaattgaaccctatggaatctacgctcacccttttcattccgccacccttgacttgaacagagcagtgctttctgccatagcattagcggaagtggtttgcctgtatcaacgtctggacaaatgctggcaaagtttagcacttcatgacacttacctaggtcatacgtgtaagggaagtcatcactgctaatccgtgtcaagtcttgcaaatgccgccagcaagcaagtttaatatcttgtccagccatggtagtaccttcaagcacctgaaaagcataggcagtcatagggtcatgatatttgtcagcaatcttatcgtaagcaccgttatctcgctgctgtttgtaagctcgttcaacagtccaatctggcaatgttaaatcatagtctaccaactcttgtcacctgcctttaatgcttgcttaagcgttggaccatcatcgtcatcttggttatccaagacaattgaagcacgcgcttgtggactgagacccaaagcatcacttaatgacttaatcttggtggttgcatcattcaaaatagcagctgcagggttctttctacttcccgtgcttaagccattctcatttatatcctcatatgcctgtcttgataattgaatctgttggcataaggctattaccagtggcttgtcaacttgtttgcataatcctgctgcgtttaacagaggtacaagctctcgccaagctgtataagcatatccttgcaaaaatcttggtggcgtaacttgtaatggctccattccacttgtcttctttgctagctcctcagttcgtgcacgctgatccgcacgatctgatgcatcttgtgttattttcatctttctgcccatgtctgctgtacctcctttcgtttcttttctatgtaaaagcttatgcatcaacatatatagcacttcttgcactgcctatcatattcatttgctgtacttttgtaagcatgacaaatgccggtatatcaacgtttgaaggccatgatgtgacccatataaaatatttttataattgcacattttttgagagaagaccattttgttatgtgaggtccctctctacgcctacggggggcgggcattacagattttttatttttaaatgcgttatttaatattcgctgttcattatttattgtttatgatttatcattttaaattctaatggtttaaataatggctgtgcaagatcataatttgcctcctgctgtaccccctcactatatatacgtatgaagtgcgtcatttttaccttatcaacacaaaaagagccaaccaacggctgacccttgcttatgtataaaggtgacacaacatggagctaactctctatttgcttaaaacgtctttttaaagttgtttcacttattccagttattcttctaattcttctatacgaaagatttttttcgcgaagcctaaatgcttttctgatatcatcttcagaatatgtatttggacgtccctctttgaagtgagggttgtgcgctctggcatattgttttccttcttgagttcttgatattatcatgtctcgttcaaattgtgcaaaagctgagaatactgtaaacacaagtctacctgttggagtgttatcaatggttcctaaattcagaatcattactgaaatattcttgtcaaacagtcgctgaatcacttctagtgcttctttggtatttcgtgcgaatctgtcaagttttgttacaatcagcttgtcacctggttgcatcaagcaaatcatttctttaaaaacaggtcttaccatagttgttcccgtgtacttttctgagtaaatccttattgctcctgcctgctttaacgtttgtatttggacacttagattctgtccgtcagtgcttacacgtgcatatccataaatcataaatacacctcgatcaataaaaaaagcagtccgcaatttttaagttgcagactgcttccatttcttaaacaatgaaactatatcacagaattataaagaagtatagtccctgaaaatgaatagtttcttagaaaaacgcagtctgtcatggtactattaacctcattccttgctaacagagattcatactataacttaaaagttatggacgatctcataaggaggaatatttatgtcacaaactggaaacttaggaagatccgcagctttagcgggagctgccactttacctgtaactggtgaacatatttttaactttttgccaatagttggaagtgttttaattttagctattgcactttttagtgggtacaattttttccttagaaaatggtataacgttaaatgattggttcgagtcttcaaccatacatttatagcctaaacattttcattctatgtatgagtgcattaggcttattgaggatgtttatcactttctggtttgcaaatgtgtatgactatcagtttataaaatacagatatgctcatcacaggaggataaagcgttttagtccttcaatatcagttattgttcccgcctttaatgaagaaaaggccataatccaaacactggcctcaatttgcagaagtacttataaaaaaatcagcattgtagtagttgatgatggttcgtctgataacacagctattttggtcaaagaatttatcgaagttcatcctgataatgatatcaaactgattcagcaaccaaactcaggaaagtctgtagcaatcaataacgccctgtttaattatgacaattctgtcctaacaatggttctcgatgccgattctctcctaaaagaagatgccatagagaaaatggtcaaatggtttttgaaccccaaaatagtcgcacttgctatgaacgtgaagatgttaaccttaccaacctttattggagcatgccagcgttttgaattcataagtgcttatagaggtaaatgcgctgaacacgtattgaaaacgctttacatcataggaggcattgggtctacttttagaacagataagcttaaaaatattggtggatacgacacgaacactccgaccgaagacattgatctgactttaaaacttctctctaggtagtgaatggtgaaaaactctaaaagtgttttcataataggctttaccaatagttaagcgtataataagtgcaagcctcatttgcccgaaatgcctatgctttgggatttacccttgcacttatcgctgacctatcggaggaattgatcatggtttatcgtcaaaaagcaacgcaactgtcacttgaatcctttggaagcgctctgggaacaccgctcagcccggacaacgagtgggttcaatatgcagaattgatcccatgggccaaacttgaagaggcataccaattacagttcccttcaaaaaccggccgagcagcgaagccatttcgattgctttatggcgcaacgttgatcaagttgaagaaaggcctgaccgaccgccaagttgtcgacgatatccgtgatacaccagcctatcagtacttcatcggattacccgaatatcgcgctaagaagccatttgaacacacaacgttggtgcactttcgccaacggctttcagccatctcagatttgatccgcaacattactaatgacttcacgcgcgagcggttggaggccgatctacctgaggggacgcatgttttgattagtgatgcgactgccgttccggtcaagatcaagtatccccaagatacaacgctgcttaaccagagtcgtttgaatctcgaacaaatggtcacagatctggcccacgggttaggtgtggaaattccgcggacatacagacgtgaagcaaaaggtaagtggaccgctttttcgaggaaaccgcggcgtcaaaacaaggaacgccgcaaacagcttcaagctcagctacaatacatccgaagagatctgcgatatgtggcggaactgcttgcgcaaggcggtcagctcactgattggcaagcacagcgtctggaagtgattaaacaagtctatgagcagcagctcttcatgtttgagaaccacactcaccatgtcgagaatcgcatcgttagccttcaacagccgtatatccggccaatcgtgcgaggtaaggcaaagcagtccgttgagtttggcgccaagattgactgttccatgttggatggcgtgattgatgtagagcgtttcgacttcaattcatttaacgaaagcactgatcttgaagtaacgcttgaccatgcttttgacctagtgggtgaatatccggatgaggtgctggtcgatactctctatcgcacgcgagataacatcaatctgtgtaagaagctaggcattaaacttaatgggccaaagctgggtcgaaagcccaaacatgtggatccgaaacagcgcaaagccgatgtcagtgcggaaaatcgtcggggtgccattgagcgcaagtttgccttcttgaaaggttcacttgggcttgacttagtgaacaccagaacggctgagtccttggtggtaacggtggatagcgcgattgcattggcaaatatcgacctcctccttaagcttttttctgtaccaatttctattgtggtcgaacagggtggcctgcattatcaaatcaactataaagtgactgaaattcggccagaaaccgcaacctaaatcaccagccactaggtatggtaataaagataacattataggatatgccaatgatgcagtagcctatacccaacctgtgaaaaagtttaaatctttgatcaaacagagatatcgttggaaatatgggcgcttcatagcattcgtaaaatatcacaatttatttttcaacatggataaaaagtttagtaagatgctaacttttttccagttgccgcttgcagttttccaggaactatttatgcttgtagaaccttttgtgtatttgtatttattatttgttacaatttatttccaagatttaggaatgtttattgcgatggtgtcttacgtgtttgtagttatttcattatcagtaacagcttccagagaatcgttaaaatcaaagttgttgcttctgtgtaccgcaccattcaatttttttctttcttacattttgacaattgttgaatatgtttcattgattaactctatacttcacttacattctatagttgactataataacaaccatgcaaattggagtcatgtagagcgcctatgaacgcatatgaggtatgcagtaatttcctcatattttataaaactttaccctatacggcttttcaaaggaaaagccgttttttgaatatgttaaatcatacccatcaaccttatcgtcattggatgtataagttcttgtcttccattaccacttgccagccggcatcttttacctcgtccgtaagttgactaattgcttcattgtttaaatctgccagctggatagtaatcagtccagtgtcacatccacgcgtcattagcctgtcgttaattatttgcctatactccaataaatcttcactagattcaatgacggtctcaggtgtcaatatttgacccattggttggtaccctggtgcaacatattcgacatccttttcaaagtcattatccattttgcttatcctctttcttctcttttaaaacttttgtccaccattgtttgtttaagtgttttaaaattgtgtctccgtttggcttatccgctattagctgttctaactttgtcttcctaaagtgacacttgtaacacaatgtccataggtttccactgtccagtgcttgcttggatgaacacaatcggcggcagataatgtggtcaactatctttcggtcttgaacaacattgccacacacttggcaggtggctaggtctcgtgcatatacatagtccctcactgcttgccattgcttagaatggtaaaaggctactgccttagggtctcgctgctttttgtcatactcttttgatttgtttgccttgattgccattgctaactttgaccgcctgtagtcggcctttttggcctgccatgattgctcatgcatggccttatgctttgcacagtacctttcgctgattggtatgattttgtgacattgtggctcattacattcatgccaaagatttttcccctgtcgtctggtcaaaatggcaaatcactgtccttaagcccacttaatttgggactaagtgaattaatcaagtcatcactcagatttgctgatgaatcctttgatgcatcattgtgtggcttagaactgagcagatatatgtgttctgctacaacttgccatgtgtattcagtttttccgtccctttcatactgtcctgtacgtatacgcccgcttatacctatccgagttcccttagatgcataattgctaagaacttctgccatttttccgaaggccacaattggaacgaaatcagctgtttgcttatcctttgcctgactataaatcctatgtattgccagcatagccgttgctgaattgttccctgacttaacactgttggcaacatttcctactaagttaactgagttcattgctcttctccttcaattcctgttcacgttttgccattaaatttaccaatatgtatttatctttgcctgcatgtgcaaagtccttgatcaggtgcccttgaaaggcaacctgagggtcatcgattatgttgtctatgtattcttcatgttcgccaataaaggcctgcacatcgctgtcgcttgtgtctgggtcggttatgaggtcatcccattcttttagcaatttaagttcctttgtgtggctattagattgcttaggttgccgctgacgagcatacttgcacaccttaactagcttattattgaactgtctgggcgtttgatgaaatcgcaccattgtctctttttgggcaaccctgagcaaactttctgcccaacttttagtggccttattcttaaacagctcttggagcctttctaaggcctctagtgtctcagcttcattacttgcctgtcgggtcatgtgggcaaccatctgtgctttttcaacctctcttgaagcactcttggcttgctttcgaacaaggtcttttctggcgtacttaactttccatttcaaactcggcgactctgctgcgatagcaatttcaacatctttgtcggaccatttatgaagccggtgactaaggagttcaatcagaagctcctgtgaagcatcttggcggctcatgtgaagcatgccagctagctttgaagcgttactgaggaaggctggcgttgatataagctccttaattgtcttttctgaaagcaactacttttcgccacctttagtccgtaggccaatgattgctgtaactatgcccatggttacagcaatgccaagcaatgccagccagtagtttaaaatattagcccatgacaattgtgtgatacctgcaatgtttgcaattgttaggaaccaaccagctgagttaagaatgctaaatgtgtcgagggtgacattttctttgtttttcatatgtatgtactttctttcttgtctatggtatggtattaattgggaagttggaaccatttttcatctggcgaaaacaaaatggtaaggcttgttaaggtgtaaggtgccattagctgagcctgctactgatgtgttgcttaaccctacggcctcagcggcctcctttatggagctatatacctcaaacgagctgtcatcgttcacttttcgaactggtcgcccattagctcttttcattaattgccgcctatgctccttcactaagttatctctatggctaacccatcgcaaattgtaaagagcgttatttaatctgttgtcatcaatgtggtcaacatcagagaggttctcaggattaggaatccacgctaaccctagaagatgtgatagggtaacagtggtgtgtttgtttgagccgtcctttgtcacgccgacaactacataattactattgttaatgtattgcttgataggccgattggaccgaggcccaataacaacgccatttctacttatcttgtaacgtgaatagggtggtttacactgtttaaattcctcctcatcatgtgccttaatgcgtgcttttaaagttgctttgataaaaaattctaggtttgattccttatttaccgtgcttgtcatcgttattattcctactttcatatttgttctatactttaattataccacgtttgttaatatttcctgttttgcatcactcgattatctatgtctgttaaaattaccccctatttattccttacacttataaatatagtgtttgatccatttgtaagcgccttacaaaggctttttaatatttcttaaccttttcttaacatttgatgccacatgctatgtaatgttgatgtgtgctgtggctgtgaagtaaggcaaatgatgagctgagggttgtaaaaatgctcctgacgctgctagatcacattgctgacaagtttcaaattacgtcagcaaaagatgtcagcacaaaaaaaagacgacccatctctggatcgccttaagtagctagagttaatcctccattcgtctacctatgcattctcaccttaagctctttttttagcttgtcatttttgtcagccagcttttccctgcacatccttaaagcttccttagtcgttggtacaagcaacttttcagccggtttagtatccttatagcctttcagttcataaccgtatctaccagcagacgcctttgaaagtttttccatttcgactggcttaacggtgcaaacctcgtcaacccattgccttgctgtcctgtccttaacgcttgctaagctgctaatagtatccgctgctgctttggccgtcatgataggctcattggtataccctttttgagcctttatacccatgaaaaaatttatttctcgtttcccaactccgcctgataaatctggaaagtagtcacttgcaaccttctctccgaacaactggataagcatttctttgctgattggggtgtttaggttgagggtaaagttatcactcaccaagtcccagttagaagtgttgaaatcgcctagtatgtacacatggtgcgacttgactaatttactaccattgttaaactccattagcttcttccctgaatcagaaagttcatcgggttgtgctaagtgaatggaccctgcaactcgcattaacacaagtgcattagcaatctttgctttggtggctttttctgggtgctcaagcatgtccatcattaaatccttagtgatgtagatacctctgcctggttcttttgaaagctgatggcctgtaacttgattagcggcaagtaggttaactgcctgatatacgtcagccatgagcttcttgtcatcccgccaagggtcgaacttattagctggtacaaataaattcttaactgctttcgaagcacctgagcctcttccacttggcatctgtaaaatgttcgatgttgctattgaacaagctcgcttataatcaactcgctgaagcatttctggataaaattgtttaaggaatgctggcagctgttcttctggtgatcccaagcattcaaggaaggctggcaccggattagctttagaattgctggttaaaataactttcttcccatttaattcctttctctctttagcccccacaatttttcctgtgctgactgtgttaagcaactcagaaagttgcgtcttcttggctgttcgagtggtgctgtgcttggttagttcagcaaccttatcaatgttgtcagcccagtttgttagtagctctttattcttatatcccataatattctcctcattcattgcctgtcggttgctcccgattaggctttttttgttacaaatagttcatcaatatttgcatgaagtgcttctgctactcgtgttgcaacaccatagctaactcccacagtgttcatgtgagttacacttgaatagcttaaatttgttacctctgcaagctttccttttgaacccaacgacatcttgagcttggcatcaaagaagtttaaatccctgactaccattgtatctggatgagttttcttcatttttttcacctttcttcataactacacaactacacaactacacaatcttgcctccctgcctcaaacaagtaggctgatttttccgcaccagccacacttgctgtcttgaacgaggagaaggaggaaattcttcctccatatatatatatatacgtaaggtaagcgccatttttgggggaaatagctgataaatcttatttccttattccatttgtcacaccataatttctcttacaacttaagtatacactctttttacttaaaagtgatagtcaaagtctatcaagcatatgtcaatactaacctatccatttcttttacaacttaattataccacgttattaaaaaatatgagtcgttataagcaacctgtatatcctttacctgcatcacaccctttcaaagagtaatttagcattactattctaattgacaaaagttggaaaagtaacaggtaatccacaaagtttgcagaaagtgcttataaacgttgctgtgtgggcatctaaagggggtaaaagtgtggaaagtaggatggcaaaaaagtgtgcaatttgctcacgagcaaaatacatgccgtaaacggcttagtatcagtagttgtaagcgcaaacatggcctatttggcatgtacaatagtattacttatctacacatgcaaaaccagcaagctgtctttgatgtctagaacgtacaattgttttagcaagggttacaagtgtctacacatgttttccatggtcaatcagtgtcactctggcttcgccttcgttccacaagaattgaaaagtttaacaaaagttgacatggacgactgacggtttttgtcagttggttatgtcaaggtatccagcaaccatgctggcgaggggagacaccggtttttggtgtcgggggcgagtagccccaatacttaactggtaacttaatagtaaactagctgataacttaatagcattacttaactccattcagccatcgctacgctctagcttcattaacagtaagcaacctttgcattctgaatacttagcaagggtagtaatagaagcaattagcaaagaacgctaattggggctactcgccccacaccaaaaaccggtgtttccctcgtaagctgtatcagcttaagcatctgactaagcaaagaacgcttaaccactttaaaaagtctaaaagattaagatcattaaggtcaaaaccatgcacccgttgcaacctaagcattactaactccattcagccatcgctacgctctagcttcattaacattcaggataaggccttgtaactaggctaaagagacatagcaatttcaaaatggaaaagagttacaagtgttcatcagtgttaaaaaagtgtcagcaagggtttactttattccaatcagtgttaacaagtgtctaccgtgtttatagcaatttcaaaatggaaataagggttaaaagattgagtacgccttgtgaatatttgagcattatatcctttattgtctactttttaaaacgcaagttatgctcgtctattccactttagatacacgatgtataattgtgccaacctgtaacagaattgcttagagagccaatatgagccttctaggggtactgtagaagctgatggcctcttctgtgcacaccagtatgcctctttgttccccctgttaaacttcattagttacaccagcaatgaagtcctaccctgttggcttcttaatgctctagtaacccctttgcctacaatgacactaagggagcactaggacggcttagagagctaatatgagccttctatgggtatcccatggtgtctaattcaaatcacaatggtgcccactttccaatcaggtgtaacaggcagacactcttgtgatgctcactattaggccatataaggaagtatggaagaataggtacaattacacatgctgggtactaaaggcgcttagagagcaagtgtgagccttctaggggcacgtggtagttaattagcttgtgcataggggaatgaatcacagccagctcacttaatgtgctagctaacacgctattgaacacctaggtggcaaattggtatagctacttttagggcacaaaaatagccctaccacattaggtaaggctaacatgcctgctgacgttattttattttctaaatcatatgtgatctcatgttatctaggtgctgaataaaatgttgaaaatagccatgaaacaagcaactttttcagctatttgaaacaccattcaggcccctaaaccagtaaatacagtaatgaaaccatagttaaataactagatgcgcggttccaccctacttcagatagaccgaatctacctgcagctttgtcatttggttcgaaaacgccaatcacattcaccaccatcaggcttacactatccctgactcgcttgggtttggtacaaatgcgaccctttttctcatcaccgattcaatttccttattagtatagcatcgcggctaggggtgtcaagcgggttttctgaaaaggaccacggcttttccatcaaaacgatataaaataccctgaagtaacgtctaatcacgttatcgctaatcacaagtcatctcgtgtcattgaccagattgctaaatcaacttgccgaccatgaaaacaatatgactttcgaagcgttccttctatcttcatacctattcttgccatgagattcatcgattttagattgtcaaatgtatgtctcgcatacaagcgctcaccttcaagttcagtaaagaagatgtcacgtaatttgattgcagcttcagttgcatatccatgcccttcaaattttttattgagtacataacttaactctgccgatttgttacgatcgtctaagtttaagaaatagattgtaccaatcaacttttcattcaaaaaaatgccatatttgccaagcccattctctataaatattttttgaatgatgtcttttgtatcttgcaaactcttattggtttcaaacacataataggcattctccggattacttgcatactcgaacatgtcaggcgcatcgtcaatcgtaaccggtgccaacacaagcctttttgtttgataggcatgttttaatttttcgcgcatcggcttacctctttcctatccacataaaaaaaataaaagacataaacatactccgctctcgatgtaaatcagaccgttctgaaaagacggtttggtttagcgataacgataaatcaatactgaaaagaaatatgaaatcacatataaacaggcaacggcagcaacggcgacaagaaacaatgaagctttgttttggctcatcaagaaagcctgtagtttcgcggaccggatccgcggtaggattgccataagaagaaggataatgatgaaaataaacatcaggccgctttgtgaaaaagcgtacatagccggaagtaagataatgccaaaaacagaacatacaacaaaaatgatcgcggttatcccaaataactgcatcggtgacgttttcggtacgataatctcaatgataaggctcatcacaaaggcaagaaatgatgttgcaaaacaagcgatcgcatagaatacgtacctagaaccaacaatcttgaatggattcaggtgataaggcactaaaaaatctttccagtgactttgattatcaagctgaaaaagcgtctcaagcgcaacaatggcaagcgcagaagaactgaacacaaataactcggcaatgtctttgttaacgaaaactgcaaccagaaaagcgccaaacaaagaaatcatgacggggagtttaaggattcgtttcttgacaattataaagtctttaatgagaaagcctgtcatttagtatcccccacttcttcgtggctagcaaccaaaagtgacttaagaacagcctcgtctgtttctggggttaaactgaagtctgttgtgatgctgccatttgttagaaccacaaaccgattacacagctggatgacatcatctaaaatatgtgttacgagaataatgctggcaccggtttgattttgataagcttttatttcattcagtatttcaatccgagtcagtgggtcaatcccgctggtaatttcatcaagaatcaccaaatcgccgttcatcgataaacagactgccaagccaagtttggtttttgtacctttagagagatcaataaaattagtttgcttggggatttttagtttatcgatatattgtctatatttttcacgatcccagcgtttaaagattttgggaaaaatatagtcaatgtctttagctgacaagctttccggaatgtaaccatcatcaaatgccatagaaatcgcagtgccttttttaatgaagaccgttcccgaagttggcttgagaatgccgataatcgtttttaatagcgttgttttcccagcaccattactaccgatcacgcctagaacatcaccagcgttaatgcttaagttaacatctttaagcgaaaaatgtccaatctcaaccgaaagcgcctttagcatcagaatataattagcatgctgtttccctttgctgctgttcatagaactagcctcttctgtcatagaaattggcgatgaaaagaatagccagtgttacggtcattgttccaagcgtcgcagtactgccaaatcccgcctttacaatgactaagatgtctacaatgatactaatagctatgattatcttaaagaaggttttcaaagtaaaaagcctcttttcacacgtggatgatggtccagtaagcctctaataatagaaattttttggtgaagtttgtatcttttaaagatgcgtgttccggcttgacatgaaccttatttcgtttttattgacgtacatttaattgctggcatgataggaatagttttatcttatcactgctgtgtaaaataaatgtatacaatcggttaaattttagcgcgatcatttacacgctagaattgacttaaatcaagcacgcgaatagctccctaaacataaaagcgaccgtaacgccaaggtatggcgtacggtcgcttctgtgcggttccatttatttagaaagctcaaattcacccaccgcttggtcattcggccaaaagctattcccatcaagttcacactttccatgacttgccggagtttggaacgaatgtgacccttttctcatcaccaaattaattttctttgctagattggccttaaggttgcttgtatcaattcacgcctgacactaagtcgatacgttctttactgttattccaaagttcttgtggcgtatagctgtccttttcaaatagaatgacggaaccatccttttcgatgcgggcatttgaaccgagccactgccatgtcggaggcaaaatcaagtcaacccgtttgcctttaccttttttaagtgaccaagccgaaatataatcctcaatataatgtgatcgcaggtatctggtttgcccattatcaaactcgattgctaatatatttgccgccatccagactttgaccgcctttggcagtgattcacccattattaaaatccccctctcacaaaaattgattaagtgattattgtcttcggttaaagttgtcactatttccgcaagaagcatcacctcaaacgtgtaaccgcttacttataacttagcacacagagaaataaaaacaatcagttaaatcaattaaatatgtggacgatcattattggaggaatcctctgactttgtacgatccggcaaccgatcctgccaatgattcatttgatcgataaaccgcttagcttttggcgtcaccccgaccatatctacgtaaataacatcaagaattcgcttgagttcggctttggtcgcgggctttacatcaattcgcttgacttgactcaaatcaagcgtactgaaccgtcgcagataaaaaatggcgcgcggactggcatggagtcgatgcgggtccttgtcccaatgttgctgacacaataagccgccatagctttccgaaaaatccagtggcaaatcagtgcggccgtcgatgacacagccgcgccaattgggttcaacaccgtaagctttaagcatttgcacttcaaccacattggcgataatttgcgggtcaaggccggtgtcaatcaaatgcaaggcttgtttgacttgtttgaaccaaaatccgactggccgcccgtctggaaaggctaaatcgagcaagccgaagatgtaggctgcataggcgttcaaggtaatatcattggagatttgtcgatactgcgtcggattctttatagcggacaagtaggacagtccagaatcgcggacctcaccaatataatccgcatgcgtaaagggcaaaatgccagcagctaaagtaaaaccgggcttgcgggcccggtttaccagaaacatttttttaccgaactgatccgtcaaaattttgaccagcatatcggattcacgataattttgacgggacatcaccagcccctcaaaggtttgtgtttgtttgaccattaacgcagatccttcatgttataacctaatgatttaagataagcattgttgtcgcgccagttcttttgaacccggacccatagttttaagttaactttatcgccaagcaggttttcgatatcgcgacgggcgcggataccgatttgtttgagcatttgtccgccgcggccgatgataatgcctttttgactatcacgttcaacgataatgtacgcttcaatttgcagtttgccgccttcacggtccttcatgcgctctacctgcaccgcgacagcatgcggcacctcatcacgggttaattcaaggattttttcccggatcagctcaccgacaacgaaatattcaggatggtctgttagctgatcttccggataatactgcggtccctctggtaatgtggccgtcagcgaattcagcaactcgtccacattattccccatcgtggcactaatcgggaagacttgtgcaaaatgataatcatgctgatagctttcaatcagcggcaataaatcatccggtttaaccaagtcgattttgtttaaaatcaaataaaccggcttcttcacttcagcaagctggcgcaagatatacgcatcccctgcccctttttgctcatccgctgcgaccatgaacaaaatagcatcgacttgattaagcgtcgataacgcggccttatccatgtaatcatccagctcgtttttaggtttgtgaatgcccggcgtatccacaaaaacgatttgggcatcaggggtagtgtaaatcccgttaattttgttgcgggttgtctgcgcttttggcgacatgatggcaatcttttcccctaaaatacggttcatgaaggttgatttgccgacgtttggccgcccgatgatcgcgacaaaaccagaatggtgttcactcaagcctgtaagtctcctttcgaaaaagcgcctggcaacaatgcctgcggggtcgtttgaaccgtttcgccgcgcacattggtcaaggtaataaccgcatcggccgcaaaaaattcactgataacttgccgacacgccccacaaggcgctaccggtccttttgtatcagcaatgaccaacaactcatccaactgagtgtacccggcgctcacagctgcaaaaatcgcactccgctcggcacaattgctcaacccgtaactggcattttcgatatttgccccggaaaaaatccgctcacccacgcgaacagctgcacccacggcaaagtgcgaataaggaacataggcattctcacgtgcggctaaggctgcggtacgtaaaactgacaacattcaccaactcctcaaaagcgctaacagcggcggtccaaaaacataaatgccggcaactaccgcaatcagagaaacgatcaacacggcaccggcgctcatgtctttaattttctttgcccgcagatcgtaatgctcgccaataatgaaatcgaccatattctcaacaatcgtattcagcagttcgcctaaaaataccaacaaaatcgccaaaatcaaaacgaaccaagaaaatggcggcacttttaaccagatcccggcaataatgaccaacgttgcactgacaaattcgcgtttgaaattgttctcatcgacaaaaaagacgcgcagcccatcgagcgcgtggcgggcgctttgaataaaatgcttgtttttgccgatttgcttatcgggtaaggccataagcagtcagaattttcttttgcagcggaatcatcacggcttcatcttccggtttaatatgatcatacccgtttagatgcaagaaaccgtgaaccaccgtataccccagctcgcgctcaaagctgtggccgtattctttggcatggcgccgaacagtcaacggatcaatgaataagtcaccaatattttttgccatgccaggcagcagtggcaagtcatcctcgccatcttcaattgcaaaactaatcacatcagtcgcgcgatcagtatcgcgatattcccggttaatcttttgaatcgcatcatccccaacaatggtaatcgacatttcggtatcattaggtaacgccaactgttgcccacaaaaagcaaccaacttctggatcagctcatgatgctggtcatccagcaagtgatcatcatcgtaaaattctaaatccattgtttactccttcgtttgcttttgcagctgtaaatcatgtttgccataagcttcgataatcttggcgacaactgggtggcgcacaacatcctgtgcggaaaattgcgtgaaggcaatatgactaatcccttttaataactgttccgcttgcaataagccacttttggcattatgcggcaagtcaatttgcgtcacatcaccattgacaatcattttcgagccaaagcccaggcgcgtcagaaacattttcatctgggcctgagtcgtattctgggcttcatccaaaatcgcaaacgcattgtccaacgtacgaccacgcatatacgctaatggcgcaatttcgatgacgccgcgatccattaggcgatcggtgtgttctttccccaaaacggcatataaagcgtcataaaccggacgcaaataaggatcaaccttttccttgagatcaccagggagaaagccaagactttcgcctgcttccacggccggacgcgtcaaaataatccgctcgacttggccggccttcatggctgcaactgccatcaccacggcgagaaaagttttcccggtaccggctgggccaatgccaaaagtaatatcgttgtgtttgatggcatcaacatattgacgctggccaaaattcttaatccgaatcggttgccccttggcgtcgcgtaacaaggtctcactatacatatccgcaaaatattcgagtgtaccccgttttgccattgcaaccgcactagcaatatcctgaggtgacagtttgatgccttgtgctaataacttagttgccgcctcaagcagctgtagtgtcaagctgaccgcttcggtttcgccgctgatgcgtaattcgtccccaaacggcgaaatccggacgttcaggccttcttcaattaacgttaaattcgcgtcattaatcccaactaggttaattgccatatcaggattactaaaccggaaaattttctctgaggtttcctgtgccaaatattggccccctaacaaataatttaagcattgaatgatggtcttagtttagcatatttttaaagtagcgtcagaatcgtttaaacggacgtaagtgtcaactttttctcggttctactctaattaagtgatttccgttactccgagctggctccgcggtgactgggctggaacgtggtgggcacgacttcgaacccgcaaagaccgcggtttcgaagctcggccttggtctaaagcggagccgcttaagaccaatttcaccactgagcccgccaccactccgccagctcttgctttctatcttagtaatcgaacaaggtgactcatgatgcttcaacaccatcaacatcaagctgcatttaaaattgttaaacctgtttgtttaggttgaaactggcgtcaaactgcttggcaattttactaacgacaaccattcatgctttaaacaacagggttcaaattgcctcaaatgcctaaacttcaaaagttgatctgcacgccggactctcgacagaattgcctatggttacacaataaaaaagccggtgctaacaccggctttgtcgttaactaagtttttctttaaccacgctgctgacaagtgcaccatcagcttggcccttgaccttgggcatcagcgtcttcataaccttaccaaagtcttgcttgccagttgcaccgacttctttgattgttgcatcaacgatatcggcgacctgatctttgctcaactgggctggtagaaaacgttccacaaccttgatttcagcttcggttgcctcaacaagatcagaacgaccgccttttttaaattcagaaacgctttccttgcgctgctttagttcagttgcaagaacgcttttttcttcatcttccgaaaggtcgtggccgagtttgatcttctcattgaccaaggctgtcttcaacatccggacaacgctcaacgtcactttgtccttggctaacatgctttgcttcatctgagcattaagctcatccattaaagccactattcaccaagtcctttattaatacttcttgcgtttacgcgctgcttctgacttcagcttgcggcgtacgctaggcttctcgtagaattcacgcttgcggtattcagcgagtgtacccgacttggatacagtgcgcttaaagcgccgaagagcgtcatcgagagattcgtttttcttaacaactgtcttagccatgtgatatccctccctccgacacttgtgtaaccactgacggatatcatagccaatagttcgtttattagtatacaaaactgttaaccacgcgtcaataagcgatttcagatttttatataaacaaccaatgttattgcttaagtttcgccggtgagccgtctttttcgataaaatggcaccgaagcgtttatgtccttacctaataggcttggctacacgttcacaaataaattatgctatgatagcgttatctaaggtagcgaggtggcattatgacccaagaactgaatttatatattatgtcagattcggttggtgaaaccgggttgcgacttgcccaagccgttgcggcccagtttcccgaatttgaagcacattatgtccgttttccttttatccacaccaaagagaagatctatagcgccattgatgaagccaagaaggaaaatgcattggcaatcatgacgtttgttacagacggttttgcccaactagcaacgcattatgctaaagatcaaggggtcattgcgattgacgtaatgtcaccgattttgagcggcattaagtcgattacgcatgaagaacctaaccatgttcccggcgccgtccatgatcttaatgagcgttatttcgatcgtatatcggcgatggaatttgccgttttgtatgatgatggtaaagatcccaagggttttctggaagccgatattgtattgctgggggtttcgcggacaagcaaaaccccgctttccttattcttggccaatcgtaacttgaaagtcgccaatttgcccttggttcccaatgcccacattcccgaagaaatctggcaggttgatccgaaaaaaattgtcgggttaaccactgatgcatcggtcctaatggaatttcggcggcagcggatgattcaatatggtttgaatccggacacagcctattcagcccgcgatcaggttaatcaggagcttaaatttgccgaagatctatacaaaaaaatcggctgcatggtgattaacaccgcacaccgatcaattgaagaaacagcaaccttgattttggagcatatgggtcttgatgaattcgacaataccgagacgcattaagccatcaacttgcgtaattcttctggttggaaatgacccgttttaagccatttaatttctgccccgtatggtgggacctgatgctttttatcagggccgacatacggggtttcgagtatcttgggtaacttttcaagtgctggatggtgcgcaattcgatttaaggcctcaaagccaatggcgccaaagccaatatttgcatggcgatctttatggctgccttgcgggttcttggagtcattaacatgaatgacgctaagccgatcaatgccgatgatgtgatcaaattcattcaacacgccatcaaaatcgtcctttacatcatagccggcatcgttcgtgtgacaggtgtcaaaagtgacccgaagcttgtcattataggtcacgccatcgataatcgcggccagctcttcaaatgaacggccaatttcagtgccttttcccgccatggtttcaagcgcaatcgtgacatgttggttaggatcaataatgcgatttaagcccttaacaatttgagcaatcgccgcttcaggaccggcaccaacatgcgcgccggggtgaaacggcatcgtatacgcatgtagtgcatcagctcgggcaacttcttcttgcatgaattgaacggcaaattcgaagttggccggctttttagtgttcccaagattcacaatataaggagcatggatgaccgggtgactaatatcatctttagccatcgctgccaagccttcaggaattctcatctcgctagttggcttacggcgcgtattttggggcgcaccggtataaaattgcagcgtgttggcctcataacttgcagcttcctcaactgcgcctaacaacattttcgtgcccttcatactcacgttggcaccgattaacattaaacgacctccctaatcaagataaccttgaattcaaaccgatctgtataacatcggccatgcttacaatcaattactattttgattccgcctagtaaagtgagttttcagcaaaaatcttgccgactccaagcttgtgtatgttcgctaatccgttttaggctcgtaaaaatgcccaagtattttaactgaatcagtgatggaaacaaacgcatacggatcactgtgacgcatcgcttgttccaaatcgtacatctcggcccgggaaataatggtgaaaagaatcgtcttttcttcgtgatgaaaggcgccttctgcatcgtgcacaatcgtaatgccgcgtcttaacgagccttgaatttctcgcaccacctgctttggccgcgccgtcacgatcatgacctgcaaccgctgctggcgagtatacagcgagtccataactcggccattaataaaaattgccagcgctgaatacaaagcatgcggccagtcattcacgaacccggcaaaaaagataatgagaacattaaacataatattaatcgttcccactgtgcgcccggtccgtttgcgcaatacaatgccgagaatatcaatcccgccagtcgaaatattattacgtaacgcaaagcccgtccctaagccattgacaacggcaccgaaaattccgcagacaatcgggtcttttgtcaaaggggtcaaaacgcctagtacgcgaatcataatggttgaaaagatgaccgccaagaaagtgaacagggtaaaccggtgtccaatggccttccatgccaacacaaacagcggcacatttaggaagaacagtaacgtcccagttgaaaacaagtcagtcgttgccagcgaaaaaaacggtaacgcgatattaaagttaaaccacttacgcacaatcgttgccaaaagctgagccgcgccggtgataccactggcaaaaacgccacccggctcccaaaacatgttcagcgcaactgccacacaaatgctgtaaaaaaaggccgcagacaaccgcgaccaattttgatgccgacgaattagccgatcaatttcttccattaccaaaaccgctccctgtcacccattaatcatatcgtgatcaagtataacaagggcggacaggtaatgctactccattctgtgactatgagcgcgttttcgcagcagtatcaggcaggccttggtcccaagtccttatgtgcggtccccgcgactatgaccccgttttgcaaccgcccacgcccaaaatcttaaccattgagcgacacacaaattccaagctctggcatgcgccaatgaatcggtgcaaagtcagacggaacttgacctcactattcagacaagctttattgattattaaagtttacttatcaaataactgccgatacttaccgtaaccttcttcttccagcttagccaccggaataaagcgcagtgcagctgaattaatgcagtagcgtaacccaccttctgcagccggaccatccgtaaacacgtgaccgaggtgcgaggcggcttgcgggcttcgcacctcaacccgttccatgccaaagctttgatcacgatgctcggccaatttggcaatgggtttggtaaatgagggccagccacatccggcgtcatatttatcttgtgacgaaaacagcggttcaccactcacaacatctacataaatgccatcttcataaaagttgtcatattgccccgtaaatgggcgctccgttgcggcttcctgcgtcaccgcgtaagcttctggtgacaactgttttttcaattcggcttttgatggccgatttattttatcagacataaaaaaacacctccacgactattgattatagccggagatgtttcgattgtcagcaattaaattgtttgacgttaaaagtatccatttactcggttaggttctcgtcgccttcgtgttctttttccggatcaacatcagggcgaacttcaatccctaaatctttaagctgaatgtcagctaccggagatggtgcacttgtcattggttcgctggccttactgttcttcggaaaggcaatgacatcacgaatattgtcgcgacccgtcagcaacatggtaaaccgatccagcccgattgccaaaccaccatgcggcggaaaaccgtaatcaagcgcgttgagcaggaagccgaaactcttttgcgcacgctcaggggtgaagccaagtgccttgagcattttttcctgaatgtcgcggttgtgaatacgaattgatccaccgcctagttcataaccattcagtacaatatcataactttgcgcatgtgccgcgtgcggatcggtgtcgagcaaatgcacgtcctcttcatttggcatcgtaaatggatggtgcgccggaacccagcgttgaatgccttcatcatattcaaacagcggccagtcaaccacccagcagaatcggaattccttttcatcaatcaagccgagatcgtgaccaaaatgggttctgagataacccaaggcatcagcgacgacttttgctttatcggctacaaacaagactaaatcgccagtgtgggcacccacagcctgagttaatgctgcgccatcaccaaagaacttcgcaatcggtccgctaatgccatcgtctgttaccttcaaccaagccagacccttagcaccaaaacgtttaatgtaatcttgttgggcgtcgatcattttgcgcgaatacttggctgccccgccaggcaatacaatggcgcgaacctggccgccattttgaaccgctccggcaaacaccttgaagtctgagtctttcaccaaatcagaaacatcttgaatctgcatgtcaaaccgcaaatcaggcttgtcagatccatacttgtccatcgcttcttgccaggtgatccgctgaaacggtaagtcaacgtcaatccctttaacatcgtgcatcacctgcgcgattaagccttccgtgatatcctgaatttcttcagcggaaaggaagctggtttcaaggtcaatctgcgtaaactccggttgccgatcgccacgcaagtcttcatcacggaagcagcgcgcaatctgataataccgatcaaatccggctcccatcaataattgcttgaacagctgtggggattgcggcaaggcgtaaaaactgcctgggtacacccgcgatggcaccagatagtcccgggccccttctggcgtgctagccgtcaaagtcggcgtttcgacgtcaataaaaccattgtcatccaaatagtgatgcacactccgcatgatatgagcgcgggtgaaaatgttcttttgcatttccgggcgacgtaaatcaagatagcgatactttaacttggtttcttcagtaacggccacgttgtcttcaatataaaatggcggcgtcttggctttgttcaaaattgtgatatcgtgcacttcaacttcaatatcaccggtcttcatttccggatttaccgcttgtggtttacgcttttttacgacgccttgaacttcaacgacatattcggaacgtaccgaattagctactgtcagtgcatcacgatcaattgcttcggaaaagactagttgaacaatgccttcacggtcacgcaagtcaataaagatcaagctacctaaactgcgccgcttttgtacccatccttttagtgtgacttcctgatcaagatagtcggtattgacgtcaccggcataacaggtgcgtttactcatattattttgcctccgttacttgtgtataaattttactaaagtctgccaatacatcggcttgaggaaaggccttctgctggccggtcgccatatttttaacttgcacggttcccgcttctcgttcgctttccccgatcgtcaacactaatttcgcgttggctttgttggcagctttgaactgtcccttggctttacggcccatgtaatccatctcacctgtaaagccttgttgccgaagcgcggttaacatctgtaaagcttcctgatccgcaccttggtcgatggtgacgatgtaggcatccggctgtaccggctgctggtcaccttgcatgagtaacatcaagcgctcaacccccatggcaaatccgatcccgggggtttccggcccgccaagttcctcaaccaagccgttataccgtccgcctgccaagatcgtggtatacccgccgccaaagaccttatcatccgacatcacttcaaaaatggtgtgattgtaataatccaagccgcgaaccattgtcgcatccacttcaaattcaatgcctaaacctgtgagcagacttttaacccgatcaaaatgctgttgcgcttccggagtcaaataatcaagaatcgacggcgcatccgctactatttcctggtcatgtttgtctttgctatcaagaatacgaagcggatttttaaccagccgaactttggaatcttctgaaagttcatctttaaacggcgtcagatagtcgaccaatgccgcatgaaaagccttgcgcgttgccggatcgcccaaagaattaatcacaaacttaaggtgtttggcgcctaacgcttctagcaactgttttgctaacgctagtgtttctgcatctaaaaccggcgaatcactcccaaaagcttcgacgccgatttgatggaattggcgttggcggccactttgcggacgttcatagcgaaacatcggacccatatagtagaccttgtatggcttcgcgtattcaggtccgtacagtttgttttcaacataggcccgaaccacgccggcagtaccttctgggcgcaatgccatcatgcgatcgcctttgtcttcgaaggtgtacatttctttggtcacaatatcactggtatcgcctacactgcgcgaaaaaacgtcaacattttcaaaaatcggggtgcggatttcgcggtactggtattgggcaaaaattttgcgggcaacagcttcaacctgctgccaacgttcactttggccaggtaaaatatcggctgtgccttttggacgttgataattcatgaggtgcctcctgtagtcttaagactgtgatggatggtgattgagggtgttcggaaacttggtggtagatcgttgtgatgcttgttgggctcggcaggcgagtatgtatgacacattcgctgatactgctgcgaaaacgcgctcacagtcgcagaaacctccatataaggaccttgaacccaaatggctaaaacccagccatttgggttcaaggccacttatgttccggtttctaagcgctcctgttcgcgctctaaaaaaatgcacccctcgattgctcgaagggtgcggacacggtaccaccttgtgttttactttgccataacggtggcgttccggaacttgatcacctcaggagtgtcttttcgatcggtcccggctttcaccatctccgggtcgcttaaaattgatctatcctactccgtcacaggtcttagttattggttaaagcatacggtttgcagaaagttttgtcaacggcgtacggctagatttttgaagtgatgcatttagtttttctagcggggcaggaacgcttttcgtaacttactgactaaacagctagctctaacccaaccaaacttgcagcgccaatcatcagatagccgacaccggtcagaataccggttgctgtggttgcgactggtaaaataccgctgagacccgcgacgacaaagaacaacagcacggttacgatcaattgcgtccactgtccggtcttggtaacaaacccaagcaacatcgccacaacgggtaacatcaacgcccaacttagcaacggccaggccgtgaccccaagccgtatacaggtcggcaacgctaacagaattgaaaaacagcctgctaccagcaatgtcacgtttaaatgtcgcttttcggcaaaattgatggtcgtcagccaggtagctaaaccgtttcgctgttccggccatcctaattggctgaaaaataataaggcccataaatacgtgattggtaaaagcgtactccgaagacttgaggtcggtgcgagccagttggcgatccataagccagcaagaatcaaccaccaaccgactgaacgagatgccagcaattgtttcattgcttgacgccataatgccggccaactgaagtgctgaatcgaaaccgcattaaagatagcctcattagcatccgcctcaggcaaagttatccgtaaagcagaacgttggtgagtcattcttcgtgctaaaggccgccgctccaagaataagccagccaaaccaaccagcattaaacttaataggactgaaccaccgatacataaccattgtgttgaggttaacgtcaatggctgaaagactaaatcatgggtaccggcacgactcagatggtcattgccccctaaaatcatcatgctcgtcaaacggtggcccgattcaagtgccgattgcttgaataatgcttgtaacaaaacgatgccggaaaagtcgattacttgtgcataccattttgcctcaatcatcatggcataaccgatgaagagtagcataatcaaaatgcttgtaccgaaccgaccgcgtaaaccgggaatcgtttcactgatcacagccaaggcactgatcaaccctacgccgggaatgagtatggcaaaagtcgcgataaattgacttatgtgaaggccttgaccagggtattgaatgaccatcatagctaatgtgcccatcatcacgaaaaccaagatcgttagcagcaaaaggcaatttgtcagaaactctccggcgacataccggatttttttaaacggtccggttaacaaagccgacaaaatgccgctttcccgatcctgactcatgccttgccgtgccagtaccaagccaatgaagggaaagaaaaacgtcaagaccgccacaaccccgaccggtgcccacgtcgggttattcgcctgagcaaagtaatgcggatccaaaaccaaaacccgaaaactcccggtttgccgcggtgcaagcaacactgccgaaaacacggcgaaaactgccaatagccgaaaagaaaattggcgcgaacgttgccgatagtcggttaagatcatatgcatcatgcatcggtcaccgccttagcttcaaagttggctaaggtagcgtcttccaaacttggtgtgacattttgagcaccgctgactggcgccgttttagctatctgccgcacatgaatgccgtcagcttgctcttgcatgttgctgatattaggactactcggcaacgcagcactacgcgggagaacatactcccaaacgtgtccggcggctttttggagaaaatctgctggcgttccctgaaattgaaactggccgtctttgacgatgagcaggcgacttgcaatggcctcgacatcttgaatgatgtgggttgcgatcaggacgatgcgattttgggccaacgtgcttaacaggttacgtactgcaatccgctcgaccggatctaagcccacggtgggttcatcaaccatgataatttggggatcacctagcaaactggcggtcaatcccactcgttgccgcataccaccggaataatcccgcagccgcgtcggatttttgggatccagatgcagggttgcaaacagatttattatctgctgatcagcgtcttggggcttaatgccttttaaagccgcaatgtaacgtaggtaatccaacgcggtcacatttggttggtaagggacttgttgaggcaaatagcccaatacctggcgtaactttccgggatgggctaccacatcaacatgatcaagttggatggaacctgcatcgggttttagctgagtggtcaatactttaagcaacgttgattttcccgctccgtttgggcccatgagtccgataacaccacctgactcaagcgttgccgtcatgccatttaaaacctgctttttcccgaaatgcttatgaatgttttctatgtataatctcattgaaccaacctcctgtctctaatattataatctaacaataatcctatcatcattcaaaggttctaatccaggctcctaccaaagtctgattttctgctgttagtggtgaaagagcccaattgtcattgtttccaaaaatcagcaggtgtaagctgactttatgggtaagaacatgagtatttgatgaggagtgagcgttttgtggcaagatgatcgcattcaagcggccttggatggccaaaatccaatggtcatggccgaacttcccggcggctttgcagtttttggcgatgtccagtttctaccgggctacagcgtattactgccaaaacgcgaagtcggcagtttaaatgagctgtctaaaagagaacaaagtctatttttgcaaagcatggcaactttaggcgatggcattttgacggcgtgtgaaccattacgcgtcaattacgacattctgggcaatacggatcattttttacatgcccatgtcttcccgcgctaccagtcggaggcgccggaacgtttggccaagccagtatggttgtatgacccgagttattggggtgatccccagtaccaatatgagcccagccagcatgatgcgatccgtcagcgcattaccaccgctttgaaaactacgaattaagcatcaggtcgcttttcttccccacccttttgccagcgggtttgctataataaacataacgatttttcagaatggtggggctttgtcatgaaacatatcggacaacttaagaaatggccgctggtgatcttattggcgctattgtttggcgttggtgccgcaacaaccagtgtgatggccaacacccaatacatgacagtcaaagccgagagcgtcaatgttcggctaggtcccggcttggcatatggcatcatgggtcaggtgaaatccggcaatgaattgaccattatcggttccaaaaattcctggtatcaagtgcgccttgccggcaataaaatcggttgggttgcttcatggttagtcgatcaaagcgaagccgcgaccacgagtgcgaaagttgccacggtgaatcaaccggttaacgttcgcgaatatgccagccaggatgccaagcagttaggaacgctcaatgccggtgatagtgtcaaggttgtgtatcaagaaggcgattggacccagattgcctataataatacggcggcatggatcactagcagcagtgtccagctcactggtcagacaactaatctggcgcaacctgcccaagccaatcttacgcaagccaaaagcggagccgcattgaaagttaccaccaataccataactaacttgcgcaatgcggcgggtatcaatgctccatccgtcgaaaagctcgataaaggcactgaattgaccgtcaccaaacaacaagacgattggtatcaagtcactgcccctgatggcaaatcgggttatgttgccagctggaccgtcaccgccccgaataatggtcaaacccaaaaagcggcaacgaaactatccgaagccacgattgttctggatcccggacatggtggtacagacacgggtgcgccggctaacaataatcatgattacgaaaaaacttataccctgaaaacggccgaactcgttgccaatgctttgcgggctgccggtgctaacgttatcatgacgcggacaactgacacctttgtcgaccttgcgccacgtccgacaaccgctaacaatgcccatgccgacgcgtttatctccttccattttgactccagcccgtccaaaaactcagcctccgggttcaccacttactactacagcagcaaaaaggatctcgccttggctaaggcggttaacaacgcttttgatgacttaccactagaaaatcgtggggttgcatttggtaactatgaagttctgcgcgataataaacagccggcgattctgaatgaaatgggttatatcaataacgacaaagactttaagtatattaaaaacccaacatatcaatctaaaattgcgacggatattgttaacggtttaaatgcttactttaaagccggtcatcatcaataatcggcggaaagtttgccgcggcaaaagcgcaaatcgaatataaagagccgctcaatcaggcatgaaaaattgctgattgagcggctctttatttgaattttttacttgcggaacaacggcggaatttcaattaaatgatcgacttgataatctgcctgtggtgctgcattgaggccgtccacattaaagtagatcgttttaacatcagcgttgataccggcatccacatcaagcgagcgatcacctatcatcgccgttaccgcgggattgagttggaagcgccgaagtaaatattgaatcgcatcaggtgctggcttacgcggtaacttcaaatcggcatccaccccgccaagaaataaggtgtcagcttgatcgtgagccaaaatttcccaggcactacgatcacgatgcgttaaaagcagattgtgtccaccttgagctttgatggctttcaatacagccagcgcttcaggatatggatgaatatcctgaagatacgcccgtgcccgctgatgataatccgcctctaagtcagcaacggatcgacctacttgttgcccaaagcaggttaaaaattgtttgattgatgtttctttcacttggcgatagagcgtctttggttcaatctgaccgccattagccgttaccaacgccgctaacgccttcatcatcccgggataagaatcatacaaagtgccgtcaaaatcccaaattgcgttaactaacattacttcgcctccgtatcaaataaaatcgtcaccggaccatcattagtaagactcacctgcatatcgccaccaaattcgccagttgcgaccatcacgcctaaatcacgaagcttggcattaaaggcgtcataaagttgttcccctaaagccggcttggcagcacccgtaaagctggggcgattaccgtgacgtgtgtctgcatacagtgtgaattgcgatattgataggacttgcccgccgacatctgctagtgccaagttcattttgccggcatcatcgctgaaaacccgcaatttactgattttttcggcgagatagtcactatctgctgatgtgtcttcaggcccgacaccaagtaaaaccacaaacccatgatcaatggcaccgactgtctgaccggcaatcgtaactttagctgcaaggctgcgttgtaccactgcgcgcatatacttttctcctttatttatcaaatcttgtttgtgaatgctgctggcataaaaagacagcaccggatcgtgatcattgagatctgtgtctttctgatcacccgtgctgtctaaataaaacggtcatcacccatttgcccgcttcacttcataaatatccggaacatttttaacagcatccattaatttatccaaatgggcaaggttgcggacgccgactttgacgtggatatcagccattttatcgtgatcaacccggccattgatgttgttcaaggccttagtttgggcattaaggacctgtaagacatcatttaacagcccactgcgattgtaaccgtaaatttcaagatccgtattaaagagctgcttttgtaccgcttcgttttcccagcgaacgtcaatcaaacgacccgacatttcccgtgaactttgaacatttgggcaatccgcgcgatgaactgtgaccccacggcctttcgtcacatagccgacaattgcatccccaggtacaggcatgcagcactttgctaaatgaaccagcagattatcgacaccttcaatcaccacaccatcttcggaatgggtttgtggctgatgtttctcactggaaacggttgtgactttctggttcttagataaaatggcagcttctttggccttacgatccttttcagcctttgcatgacggaacttttcggttagccggttagcaataactttaggcgtatattccccgtaaccaatcgaactcattaattcgtcttcggtttgaaagttcagacgctgcatgagtccggtcatgttttccttggtcataaaatcttttggtacatagccttcctcttgtagctcatgttcaagcatatcacggcctttttcagcgttttcgcttttatcggcctgcttaaaataacgcttgatcttgttacgggcgcgcgaggtgtacaccagtttgatccaatcacggctaggcgcactgccgctagccgtcagcatttccacgatgtcgccattttttaacacgtaattaagcggcacaattttgccattcactttggcgccaacagtatgattgccgacttccgtatgaattaaatagccaaaatcaagcggattactgccttttggaagctcgtagacatcaccttttggggtaaagacgtaaacgcgatcggtgaaaatatcgcctttaacactttccatgaagtcggcggcatcgctactttcatcctgtagctcaagaatttcgcggaagatatccaattttttgccggctttatcgtactggactttactggtctggccttctttgtaagcccagtgtgctgcaaccccgtattcagccacgtgatgcatttcttcggtacgaatctggacttctagcggcttgcccatcggtccgataacggtcgtatgaatactttgatataagttggctttcggcatcgcaatgtaatccttaaaccggcctggcattggcttccacttagtatggattgcacctaaaaccgcatagcaatccttaatcgtttcggtgatgacccggattgccaacaaatcatacagttcgtcaaactgtttatgcttgtcgcgcatttttttataaatggaatagatgtgttttgggcggccatagatttcatatttaatatgcagatccgctaaggcctttttgatttcttcgattgcttcttggatataagcttcacgttcggtgcgcttactgttcattaagtgtgcaattcgatagtactgttgcgggttaagataacgcagcgataggtcttcaagttcccatttgatggtgctaatccctaagcggtcggctagtggcgcataaatctccagggtttcattggcaatccgccgctgtttatccgggcgtaaatgttgaagtgtgcgcatattgtgtaggcggtctgccagtttcaccataatgacacgtaagtcttttgccatcgccagcaacatttttcgatggttttcagctagctcatccttatgggcaacataggtcactttgctaagcttcgtcaccccatcaacaatgaccgcaacatcatggccaaacacttcttcaatatcgcccagcgtgatatttgtatcttccacaacgtcatgcaggtagccggaagccactgtttcaggatccatttttaattcggcaagaatccccgctacctgaatgggatgaataatataaggctcgccggacttgcgaacttgatctttatgaacataagcggcaaacttataggccttttcaacgaatgccaagtgttcagggttcatgtaagctttacacaacttcatgacatccggctgggtaagttcaacttcttcggccatggtattcccctcctgagcgcgagccagcgcgggtagaagtccttccaatcaacttcttcgccagtgatcgcgtcgtattgaattttccgctcatagcggcatattgcgctgatattatgagaagggcgataaacgttctgttccgacttaatcgggacaacacgcttatcgccgcttcgttacgcttcattaatcgcgtcagttcgcgcataatggctgagtctcagcgcaagaagactgatacacagcttggtacaacttttcttagactacccttaaattataacgattctctgacaaaatgctagtcctttgccatcgccaagacgccgagcagaagataaatcggtgcaaagaagtaggcataccatttgtaacgtaaaaagaccattaaagtaaacagcactggcaagacgaacagccaccaccagcttaaatgatgccgtcgaatcgttcggcctatccacaaagcgcttagcatgttaattaaaatgaacagaacccctacccggacggcggtactaatatggaacaatggaaatacccatgggaagatcaaagttataagtacactccaacaaacaaccttattgcgaggtactttaacccaattcatgacacgactcatcagcgctagtctcctttataatcaattcagttttagtttaagcaagctcagtgagaaccgaaacggcactaagcaaatatagcggcgccgtttcggtacgtaagatccgcgggccaagaccggctggcgtaaacccgcgtgcttgcaataaggctaattcagctggcgatatgccgccttctggtccaaaaacaacacataatgaagcaggatgcggcactaaagccgaaaccaaagctgcatgttcgcctttcttggcactttcttcataagccactaacttaacggctgcatcgtcccctacatcactcagcttagcatacatcgtgacttccgggactaaattacgatgactttgctcagccgcattttgggcgatcgttgcaagccgatccatttttttagcaatccgctcagccggccaccgagcagttccccattgagcattgaaaaagccgattttggccgcgcctaattccgtcgccttttggacaatccactcagctttatcgcctttgctgacgccgcaaacaacctcaaccgcgatgggtaactccacatttttggtaatctccgggccaatctcaaccgtcagcggatcggttgtctgaaccttagcctgataaacccggtgcttaggatcagccaattcaaaaacagcaccgacatcataacgcaacactttaatcgcatgtttagcaatcgccggttccaatgtgacggtttgttggctatgtaaaagatgttcggtaaaaaatcgctgcacgcacgctccccttttctatgctggcaaacaagttatcgttaagctttcaataccgcatcaaatgctacccaaccgactgcatcccggcgttgcgcaatggtaaagccattatcctgcaacgtttgccgaatcaagtcggccttctcggcaataatccctgccagcaaaaaatggccatgcgggtttagccgtgacggtacttgcggaatcaatggtactaagacttcggccaaaatgttagcgacaatcaagtcagccgaaaccgttagtccttgcagtaaatcgttagccttcacggtaatgtgactaacgggatttaaggcaatgttagcttgggcatttttgacggcaatctcatcgacatcggttgctaggatctggctgacacccaaccgttcagccgcaatagccaagatgcctgaaccggttccgacatcaatcattgtttcgccgccgcgtaccaatgattccagtagtgacaacattaattgcgtagtcgggtgagtgccggttccaaacgccattcccggatccagtgtcaacaccaactcatcaggctgctgcggtgtatagtgctcccatttaggcacaatcgttaagaagcgcgaaacacgcaacggatgataatactttttccaaacgtccgcccaatcctgttggcgcacgtcagccagtgttactgttgccgcacccggatccaatccgaattgcgccagtgctttaacttgtgacgcaagatgatcccgcttttcaattaatgacgtagctggttcaaaatagccgatgacctgtgcaccggttgccaaatgcggaatggtcgccggatcaaaccaagtaccatgtgcatcaatcgtctcttttttgaagtcggccgcatccttaatctgaatgcctaccgcgccggcctccatcaaaatgttgctcacagcttcaaccgcttcagtggaagtcgtcactgtcaatgcagtccaatcgttattcatatggtctcctaatacaattaaaataaaaagctagcttcgttttttaacctatcaatatctttttgcgttcgtaaaaatgattaatacttaggatacggcaaaaagatccgattatcggcatcgggctgttcagccaaaatcgcttcataccgcgcttcatcgaaattcaaggcaaatgtatcgtcatcggaagtgccatccacgaaatccatcaagtcgctttgcccgtcatcaagcaggtcctgtaaataaatgaacaaagcattaacagtcgccacgtcaatcccttttttgccgttaaatccaaaaatagccagataatcatctgcatagtcggcaccgtgcagccgcgtttcgtcataaaaaagaatggcatcctgataggtaaccgggccatcatcaacggttgttcccgtttggtcttccacttcaacgccggattcactttcagccgtcatcgtgatttcgagttcaatcacatgcgcgtccttatcccagttcaggctaagatcgccgtcaaaatctaattggtccattttgtcaccaattgcatctaacatattcatttggctcatgattgccatcctctcatttctaaatcctgatcacgccgcggtattttggaaacaaacggattaccagcaacgtaaaaccgcagtggggcgcttgtccacggctccttgttaggaataccgattcgcggtccaacggcaatgttacggggacgatgatcagtcggtgccaagctcagcccgctctgattcaacacagtgccgtcgagctgcttatcaatcgctagtgcttggcataatttgcccggtccgttggttaagccgatgcctatttgcttgcggcgagtctgcatggtcgccagtccactgatcggttccagtgcccgaattaaaatacactctgggacatcaaccggctgagtcacaatgttcaacaagcagtattgtcgcattcgataaacataaacggtaccagccgccagaaaaaggctatggttacgcgtggtatggcgatggttaaatgcgtgggcagcctgatcgcgcgcaccaagataagcttcggtttcaacaatcaaaccgctacaagcgcctaaacttaatttcatgcccaacagttgccgcgcagaatctagcgtcgactgggtttctaaccaaggtaatatcatgcttattatattagcctaggtgccgccgaatgcaaagaggcgaaaaggctttgcctaaaaattgtggctaggtataatagtaatcaattagaaaggaagctgaacatggcagaaaacttggcattgcgagcactcatcagccaacaaaccgacgcactggtttctgaactttacaccgatgataaagtcaatgaacgactgcaaaagtggctggcaagggtacctgatcccggtgttgccgatacttacagttatttgctggcagaatcacgcgaattttccgaagagctgctttatcgcattttaagcaagcttgctgaagacggcgcacttaaattaccgactgaagcataaaaagagaggcggataaaattgcacaatgtaaagtgcagtttggccgcctcttttatgacgcaaaggatctattttaattttgccttaactgtttgcggaagtgcctgcttcgaaatcggttgaggtgttgtcagcacccgtttttgtgctaccttggccttcacgtaactgccaggtgttaaagccttgggattagctgattcttcagatgaatagcctaagttccgagtctgaccatccttcgtcacccattttaattcgtattcataggtgtagtattgcttcccattgaccttgtaaagtgagccatcttcatttttcgaggcctctttcttaccctcagtcaccaaggcataagcttcaacaccattgtacgtaccattccaatattgatagccgaaaaagccaataacgatcagcacgagtacgccaactacaccaaccacttttttcatcgaatcatcactccttttcgttaaacatattatgccgaatcaattaaaaccgctcaataatttgtgatgtctttatatttttcttaattcgtgacaaaaatgtcatgtgtgtaagataaaaacacaataacatcagtttcatttagatggcctcaaaaagtgacgatggccttcatgtcagcaattgccagaaagctggcagcgtctccataacgcgcgcgccagcccagaaaccgggctggctcgcgctcaaaaaaagtcctgcttctcagcaagactttagcttaacgtttaattgaacgcttgttatcttttcgtggactccgcttaagtcgatcaaaaacggattgcaccgctttaaatcgttgcggatcacgacgagcatttttgacaaactggctgaaatcatggtcaccaatgccaacttcgggttcgtcatcctttttatgcttcaaccaaggcatcatgacacctccgaatctttacgcatgcgttgagcgcgattcgcccctgccagcacgaacaccatggcaacaaacaaaccgattagcgcaaagacactgtagttcggaattaaaataaaagcaataaacgcacagatcccgacaagattgccgactagcaacaatcgctgattatgactggaaaaatacgataatagatgaaaaataatacctggaattgtcagccaccacagatggttcgcccaagacatcaatgtcgctcccacgccggtgaatgaaaacccctttggcaatgtcgtaatgacagccgcaatcaacatgacaagtgcaaacacaccataaagtaaatcataaagtgctggtacttttttaatggaaactttcaagtgtcgatcatcccttgctttagcagtacctgtattatacaagtttgcggaaatcattgcacgacagacagcgcctgtttatacaaaggttagtaactctgattttcttaacaagtaattttatcaagtaagaaattaaaaagcgttacgtcagacttaagcccagcgtaacgcataaaaatgaacttatcttataaggagagtacaggatttgaacctgcgcgccggtattagccggttcgacggatttcgagtccgttgcattaccactctgccaactctccaaaacacaagttcaagtataacaaaatcaacaaactttgggaagcaattattttaagtatcgatgttgtggtttcaaaaagtgctttaagtgaacttgtcaaattgataatgctaagccgtcttttgtaaaactcaatatttaatcgtctcctcagtcacgtattccaagtatttctggcgctgttttagcgatgaatgcgtgatattaccaaagttctgccaatgagcacgcctgattccgagttgtctcaaagtatgttttataaaaaccccttgcaaagcattgccacaaaaaaggcgcaagtaaaaagttggcgaggttgacgttgttagtacataaacatgcttcagattggtgagcaatcccttaacaccacgcttagtaaccacatgacttaaccccggaccttccttcataactttatcgataaagccttttagcatcgcgggtatatcgttccaccaaaccggcgtcacaatgataaggccatcgacttcctttaaggtattcaaatactttttaacgagaggatcgtgtgtctgcccagaatgaaataagcttagttcttcttgatcataagttggctgaaatccgtcatggtataaatctagaatcgtataaccaatagcgcgattcgataagttttgacaaactgccagcaaaatcgcgtggttgaaacttttgtcatatggatgacagtaaacaattgcaaattttgacatttttatgcctccaataagcgcagaagtgtttcgcgcaccaataccgcatcgtattctgttacatcactatcaagtaacagaccataaccttgaataaatgcccacaactgaataaataaatctttgggttgtacgctcaggtgacgtttttgaatcactgcttccaccatttgcatcatttgatcgtaaaatgcaaactctccgctatcaactttcaggacattgcgcgcaatcggattgaaaaatagaaaatgcatcaaattgggttcatttttaaattgtcgaagtaaaatcgaagcaacagtaagcagttgttcttcgggttcacgaactgtttgcagcttctttgccatccgtgattgttcctgacgtgataaaagaaccgtcaccgcttgaagtaattcttctttagtagagaagtgcgtataaaatgcacccgtggttaatccgattccttttgctaattttcgtaatgaaagtgatttttccccatgttccgtaatcatgctgatagctttttccataattcgctggtctgtatcgatttttctgtcggccattctctcatctcctttcaaaataacagtgttatctcaacgattgtcttgatcataacagtgttatctggaaaaaacaaactgcttcggtctttttttacccatcacgacatacaagatacctagctttttttgaaacagtttttcttcttcaagcttcgtagcagccctctaatttggcaacactatgaaatttttcagttgatatccctaaatagtgaatggtgaaaaactctaaaagtgttttcataataggctttaccaatagttaagcgtataataagtgcaagcctcatttgcccgaaatgcctatgctttgggatttacccttgcacttatcgctgacctatcggaggaattgatcatggtttatcgtcaaaaagcaacgcaactgtcacttgaatcctttggaagcgctctgggaacaccgctcagcccggacaacgagtgggttcaatatgcagaattgatcccatgggccaaacttgaagaggcataccaattacagttcccttcaaaaaccggccgagcagcgaagccatttcgattgctttatggcgcaacgttgatcaagttgaagaaaggcctgaccgaccgccaagttgtcgacgatatccgtgatacaccagcctatcagtacttcatcggattacccgaatatcgcgctaagaagccatttgaacacacaacgttggtgcactttcgccaacggctttcagccatctcagatttgatccgcaacattactaatgacttcacgcgcgagcggttggaggccgatctacctgaggggacgcatgttttgattagtgatgcgactgccgttccggtcaagatcaagtatccccaagatacaacgctgcttaaccagagtcgtttgaatctcgaacaaatggtcacagatctggcccacgggttaggtgtggaaattccgcggacatacagacgtgaagcaaaaggtaagtggaccgctttttcgaggaaaccgcggcgtcaaaacaaggaacgccgcaaacagcttcaagctcagctacaatacatccgaagagatctgcgatatgtggcggaactgcttgcgcaaggcggtcagctcactgattggcaagcacagtgtctggaagtgattaaacaagtctatgagcagcagctcttcatgtttgagaaccacactcaccatgtcgagaatcgcatcgttagccttcaacagccgtatatccggccaatcgtgcgaggtaaggcaaagcagtccgttgagtttggcgccaagattgactgttccatgttggatggcgtgattgatgtagagcgtttcgacttcaattcatttaacgaaagcactgatcttgaagtaacgcttgaccatgcttttgacctagtgggtgaatatccggatgaggtgctggtcgatactctctatcgcacgcgagataacatcaatctgtgtaagaagctaggcattaaacttaatgggccaaagctgggtcgaaagcccaaacatgtggatccgaaacagcgcaaagccgatgtcagtgcggaaaatcgtcggggtgccattgagcgcaagtttgccttcttgaaaggttcacttgggcttgacttagtgaacaccagaacggctgagtccttggtggtaacggtggatagcgcgattgcattggcaaatatcgacctcctccttaagcttttttctgtaccaatttctattgtggtcgaacagggtggcctgcattatcaaatcaactataaagtgactgaaattcggccagaaaccgcaacctaaatcaccagccactagttataatgaaagaaataattcaacacgcggaggagattagcatgctgaaatacggcatcatcgggggtaatgagaatgcattggaattcattgacgccgcagacatttcagaaaagtggcaattaactacagcgttcacagaaacaacgcgagaaatggcagcaatcagggaaaagcatccggaaacggtctttttttccgatcttaatgcgtttttccaaagccggcattttacaactgtcttcatcagttcaagctcgcctaatatgcgccattttccccaaattaaacaggcaatcatggccgggaaaaatgtcattgttcaaccgccggcgctcacgaacccgactgaattcaaagaagccgaacagttacttcgcactcatccagaagtacacttttttgaggccgtgtatccattgcacatgcctaattttcaaaacatcctgactgcggtgcgcaaactgcctgccatccaaggagcaacatttacggctatgcaggaatttcccggttatgatgatgttttggctggcaagcggcttcaagggtttacccccgagtcagcaggaggtgccctgcaaatgctgggcttgtatcctttgtacgctgcgttttcgctttttggccacccgagtaacggaaactatttcgccaccgccatcaacactggtgcagacgggcttggcaccattttcttaacttatccggcgtttaatatcaccattcatattggtatcaccaccgactcgtttatgccttctgaaatttatggtttacgtgaaaagatcgtcatcgacaacatcaccgaactgcggctgatcaatcattacgatgcagatcatcaaaatcacttgcttaacacgatcacctatgaaaatcgattgacgggtgaggcacttgcttttgccgaaatactagaaacgccgaacgatccccaaaatcgccttcgctatcaaacatggttggaactggcacgtgacgtgaacacgaccctattccatttacgaacattagtggggctgaagtttccaactgatgtttaaagctcaaaaggcctccggagacacacctccagaggccctattttttattgctaacggtcaaactgagacgaccagacttcaacgcacgattttctacccaaattatgcgttatctttcacccgctgatcaccgataccactactgatttcttcagtgaatggcaggggcttcttttttgcatcttctaacaacgcttcccatgcgtgccaaacgtttgcttcagaataacgatctgagaacctgtctagtatctgctgaatctggtagaattgtggaaaaccgactgaggagtttgtcatgccagattatccaagcaatatttctcgagcgcaatttgcgttaatacaacctgatttagaaaacttccgcaagcatacaagaccgcgtcgttatgatctttatgacgtattcaatgccatcctttactcgcttactacagggtgtcaatggcgtgaattaccgcacgatttcccggaatggcataccgtctaccgctattacgatatgtggcgagataaaccagacccgacagctgattcgctattagaaaggcttttaaaaaaactgtcgcttcctatcgttttgcacagggccgatcggcccgaacgtcgtttgtgattgttgatgctcaaagtgttaaaaccactgatttaacgaaaaatagtggctacgatggcggcaaaaagatttcagggattaagcgtcatatggcggttgatattaacggtttaccacaagccattctcgtgacacgagctaatgtatcagatcgttcaggtgcattggctatgtttagtttggctagccaaaatttagagctggttcagcatgtcatggttgatggtggctacactggcaatgactttgcggatcaggtgaagctcattttgaatgctaagacgacggtagctaaacgcaacgagttgcatatgttcacggtgttaccgcaacgatggatcgttgaacgttcatggagttggctagacaaatgtcggcgactttggaaaaactgtgaacgtgcccttaacagcagtcttcaaatggttgtattggccttcctgaagatagttcttaaaagatactagacaggttctgacagttcataagagcgatctgacatctgctgcagcttatcaggatgcttgaataagtcgacaaacttagccgccatggccttgatatcatcaaatggcacaacatagccattttcaccatcaacaattagctcattagggccatagttcacatcataagtgacgccaacgagcccattgctgatcgcttccatcaacgacaagttaaagccttccatcaccgacgccagcgcatacacttgtccttcgcgttgcaccgcgccaacatcctttacataatcatgcagtttaatcacgtcttgcagctgatacttctcaatggcggcattgatcttggtcattgcctcatcattgtcgcggtgatcgacgtacccataaacatctaatgagatattaggaacctcttttttagcaatgccaatcgcttcgataatatgatcaattcgcttttccggtgcaacccgggccgtgacaatcactttaccttgctgccggtccgccatagcaatttttggacgtgcaaactgttcatccggaatgacaccaaccggaattgtgaagagcttgctcttgggttgaaagcgcgtgcgcacgtcccttgtttgcttttctgtggcggaaataatcgcatcataatcattagcgtgaatcaagccatactcataaaaattattcatgaccgagtgcatcggatcttgcgcgtcacctgcatgtgaattgtgtaaatgcaagacagtataagccggacgcctcaagtgcagcagttgccagtcaccaagatgcgatcgatcaacaataaagatattggcgcgtttattgttccaatattgctcattcaaacgattataaaaatgaactgtcaactcgtcgatatccgaaaagagatacaccgctccattgtcttcggtcagccgccagccggttttagtaaaagtctgtttggcatcatacttgttaaaggtttcaagcaccggccgcccgtcaaccttataccagacctccgtgccgactttattatcaggtgtataccattgcgacaaggacaagaaaccgcgaaaatcgtaaaaatcaacccggtacagattgccgaaagcatcgaattgctcaaccgaactgacccgttcagttggatcatcacgataataattaattcttgccacaaattgttgaccacgcagcacaagatagcgaaattgttccggttctttttggtaactaagctgatccaagccaaagtcaatatcctcggcatgcaaaatcttggttggcacttcttcagcagcttggaaatagtcaaacatccctaaagtttcgtcatcgctgacaccgtttgcctgtaaataatcgtgcagtcgtgggttccactcacgaaaaatcattttgaacggttcaccgtgatcacgaaacaacccagcccgtttcaactgggcatgttcaattcccgagttgctttgattaaaactggaattaataaaaaatatcatcgttcggcactcctatctaagcgaagaaaaagatttgggacggtgctaagttgcgcttcccattgtttccaggcagcatcggcactaaatgtttgtgattgttgataagctgcttgaaccatttccggccacgtgcgtcctgcttccgtgctcgtcaacaatttcaccagactgtcggcagcagctttactttcacctgttggtaccaggtaaccattgacaccattttcaaccaacagtttaggcccatattttacgttgtatccgatgaccggtacgccatagctcaatgcctgaagaatattcatgccaaacgcctcagatgatgagacactcaacatcgcggcggcggttccaagcgctttagcgagttcgtcttctgattgataaccatgataatggatcgcggtatcgacaccaagttccttactatacgcaaccatgctttcatttgttgcttcgtcagagacgtaaccataaaaatccagatgcaaatccggaagctttttacgtgctttggcaaatattttaatggcttcttgtggctctttttccggtgagatgcggccgagatagacaattttattgcgatcacgactttcaatcgacactaaatcatgtgcttctgcaaaactgtcaggcaccaccatgacatgtttaaagtggaaaaacttttcaatctcttgcttttgctcgtcagtggccaccataatcccgtcaaaatcattggcgtgcgtggcaaacagcggcttcagataatcgacatagtttcttgaaccaccgacttgttccggattgtgggtatgaacgctgtgcaggtattgccacttagcgttagcgcccgtcactgcggccacctcattaatcaacgatgggcggtcatttattaacacacttggctcggcagccacgacttcattcatgaagaaaacaaagagctcactttccgaattgaaccgccatgcccggcctttataatcaagcagctgatacatggtattcatgagcgtcccattcacattcatccggataatctcaagcttaggagcaccttctggactataaaaaatctgtggtccaagctggccatcaggatgaaaatactgcgttgacgatttaaagccacgccgatcccaaacatctttagccacggttgcgttcatgtcattgtaatattccaatgaacccaccaaaccgactgtcgctggcgctaccaacgccttgcctacgactttgccatgatggacaatctgggattcattagcatcaaccccgacgatatgataatcaaacttatcaattacttcggtatagcgaatatcaatatcacgcggttctacaaaagtcgcttcctgaaaataatcatacatgttcaaaacatctgactgggttaatttaatgcgttttaaatcgtcaattaacaaaggattatagttgcgcgtcaaaattttagcaggtacatcatgatctttgaaaagtcgtaatcgttgcgctgctgaaaactcggttcctgagttcattgaaaaaatgttttcattcacaaaatagttcaccaatagtcccccatttcttaatggtcgtaccttgagtccaagatacgtcccttatgcctctggaaaatcactttcaaaaaccggcgcatcttctgacgggaacaccccggcttgatccagtgcggccacgttcttttgggtttcagcatcggcggcaactggctgactagcagataattctgatagccgcgccaccttagcttcagaatcagacaatgccgtttgcagctcctgctgggtttgctttgccgcagctaaatcggcctgagcatgcttaagatccgtttcggcaatttgagtggcaacgatttgtttacttaactcgttttgcaacgcttctttcgccgcttgggctttatcacgctcggacaccgctgcttccagatgactggacaaatcggcaacttgcgtctgtaacaattcattttgagccttgagttcttcatgctgctgatgcaaggtcgaaaattcgctgacaacctgctgatctttttcatgttcggccaggacagctttatatttagcagaaaggtctttcaaataagccgtcgtttttgtgcgataagtttgccattgttcgatttgagaagccaggcgggtgttcattttttgaaggacggctatttgcgtaattaaggtactattttgtttctgcgcttcgtaataaggcccgcgggttaagttagtgttgtctgtcggcacattcatttgtgaagctgtgttggcatcgtcatctgtggctggtgcctttgcctgaagctgggatacacttgcccctgccgcagcttgtgtttgtgttgccgattcagcttgactggctgttgctgcatccgtattatcagtcacaaccgttttgggatctgctaatgattttttatcagctttctcggcagcaggctcggccggctctggttgggctggcatagcggctgcttgtggctggcttgcgatggctttagatggggtggctggttgcagttgcgctgttgaagctggttcatctttgacataaacagtcagttgatcattggcaaaatttaattcagtcccgccagagatgttcatggaccaagtacggccgctgccggttgccggtttcagaatttcagtggctaaagaggctgcgctgttgagttgctcaagctgttctggcgacaaggttttgcccgttgtaggctcgtctttttgctgatcgccggtattttcctgctggagttcctgatttcccccgcccagtttctgccgttgctggttttcgctcaggcgttcatttaatgagttgagcacatccggcgtctccgattgctcttttcgattaaaaattcccatgttgtcctcctctgtagatcataagtcgaataagaatcctctcacgcatatacttaactcgatcaatttttcgtgagaattatcaaaagaacctgtatttgattactatcatcgttaaaatctctagaactgcgggcatcattataccttaatcttacaggaacgttctgcgactatgctattgataagctgggtttcgcattacttttcgcagtcgcatcaagttgtcccaaaggtgatgcattcagatagctgcggagttcggctagcaaagatgcattgacatacacaaaagaaatattaggtagcggtatactggtaggattcgttaacgagttggccattgcttttgctttaaggtaaaggcctaagtcggtgtaaataggcgcttcaaaggcataataatcgctaaactcagcgctacctgcagggggacggtaaaaactcacgcccattgacggcccgccataaattaaattcgcccgatgcccataatgtccgttaccaagcggctccgggttatcggtctcgtcataccaggccatcaccatgtaatatgcgatctcctgattagaccgcatatgatccgtaatgccagtgttcgtaccgatgttctccgttgcgtgactaacggcttcatgattaaaatcttcaacaatcgcccgcacgcgttgttgtgcccgacttgtatcgcgttccgaaattgtcaacgccgactgtccgttcaaagcccgcaattcattgacatattgatgaaagtagctgacaatctcagcctcatccggtttgaagttcggatcatctagcagatactcatttttaacgcttggataattggatgttgaaggaaaaaaagatgatagatttttcaccttcaacatctccgaagcacccggattcggtttcgaggtcagactactgacaactgttaccctcgccatgtttgcaatcagctgtttcagttttggatccataaaactaaaacggatgaaataagttccttcataagccggattaaccgtacctgttaccgaaatatcttcgagctgaaccggcgcaccatcactattagtagcactcacaaaattgatgtcaggtgtccatgatgattttttagctaacaaagtgtcttttgtcttgattgcagccactgtttctgaaggtgttggcggcaagacgtccccgcctatctgccgttcatcaattgcactagcttgattggtcacgttgacagaagaaaattgcgccacatcttttccggttggggcatcagtaaaagcatactgaacgaaataggtacctacgatcgctggatgaacggttccgatgacttgaatagcatcgattggtactgcctgtccgttcgagtcattggcattcagaaaatttttttccggtgtccaagaagatttttgggcgatggtaacgggtgctgttgcgatactgggcgactgattcgtatttgggtcagccgcagttaaatcgtgcttttcattttgatcacctgacaccggttccttggcttccggctctgggttattcgcagtcgccgtcttcatggtttccaagggctgaaccgttttttgctgggcgccgttagcttcgaagctattaaccggtggtgatgaatctttgctgccggaagctactgaagtgatgtcgggagaagcacgatccgatgcagctgaacttgtgactgtatgggttgctggctgctcttcattagccgttgtggaggcagtcacaggatgtagtgagctaaatgcgaccaaaacagaaaaagacaaaacaacctccgatgccttcatccattttccgcgaactttagctgtcttgaatttgccatggcggtccaacaacgcggactgcaattgtttctgcctcatcatccataccctccaaacttcagtgtcttgagtccaatcgtttttgaaagaaccattgggacaattttatgtagaaaagaggccaatcaactttgaaaattgacctcttttagtcttcagaaaaaacgactgaccagccttattgaataacagtgaccaatgctttgttttcaatttgctggttggattcaggatcagtaaagctgatgataattggataaacgcctggaatccaaggctttacttcgcctgacatgcggaaattttctaacggaacctgatgacctgaagaatcagttgcctcaacaagaagtgcttctggctggaaactttcatttttcttcagggtcagatttttgagttcaatttttgcatgcatattttttacctcgtcacggtgacgtatacttgttgttcaacaatttcattattattagcggcattggtgaagtagtacttcaggatataagttcccggaatcgagacggtcacgcttccgtcgatagaaagatcagaaatatcgacggccttaccatcgccgtccgtggcactgactaatgcctcgctaggatcaaaggattgtttagcccgaatgacaagatttttggtgaccagttttcctgcttttgaagagatcttagcaatggtcccaatcaagtcggaaatacccggtaattgtgcaacccctttgaggacaccggcagcgtcaggtaagttaagtttcacgcctactaactggagcaaccaacctgcaataccgccgataatcccaccgattgcagcaccgattggcgaaccaatcaagctggcaatcgtgtcagtcagcggcgtcacccaaccaaggaggataaattccaacgggttgacaatgggccccagtccgaggaacccggccgcaacaacgataacgccggcaataccgaagacgatcatgccgatggtgtaagaaatcagccagtttgagagcgtgtgcccgataagaccgccaatggttgaccctaatgcaaccccactgacaacggcgtcaacttttccatctttagaaaggcctggcgccatggtcgcaccgtaataagcaccaactgttgagccgacaatcccggttagccaaccggtaatcccaccaacccaaccaagttcagcagcgttaccaccgttagcaatccaaccaacgatcgggataatcccgacaattgaatctagaaccgttgccggaacgccagcaataaaccatgccgcaaagccacctaccgccgttgtgacggttccataaaacgcactaccaacagttccgccgatcacggattcaatcaattcacccacttgcccaagtccggttaaattaggaattaaacgaattggattaatattggtagctaaccacgaaaccgcgttccatataaagttggtaatgccacctaaaaccccggttaagctaaacccagtgtccgctttaaccactgattgtgcggaagcgattaacgttgaccttaactgtttagccacactgtcttgagccactgagattgctgattgcatggctttataggaatttgttgcttcaaagcgtgccatatcctgagcaaaggccgatccaagcgaagtggcgaaaaaggatgtggccaaagactgcgcaagacttgtgtttgaagcggcaacagcagaggatagtgccgtattaaaggcagcaaattcggaatttgttgcatacgaggacaaagcagcaatcatttgcttaccatcttcggtttgggcaaacgatgaaaccgcagccgcgcttgccaacgaacctgcaaaagcagcagatgatgcatcagccaagagtcgtttgccataagcagttgccatgaatgatgaagttgcactagcatcggcagcggattttgcctctgcagttgacgatagcgatgacatcattgattgaagtgccggatcactagcaaccgaagcttcaaaactcgccaatgatgccaatgcactaccttcagctgtggcattaaaagacgcgaccagcgatttttgcaaggcaacatcggacgtggcaacagcttcggaaagttgcgcctgaaacgcttttactttgggatcgttgctaagtgaagttgcggcactcaggaaattaacacctgatgtaattttatttgctgcttcgcttaacgcaatcctgccttgatcagttttagcaaatgacgtcaaggccgatttagcactggataacgcagcagcgtccaaagccagtgaaggagctgaagatgcggcatcactcaattcaagcggggtcgcagccaggctcgatgctgaggtctggttaacttgattttctagaggctgagctaacgtgtttggcttcacgataacgcggacattcttgccaagcttttcctgcgtgtaagggtcagtgtattcgtatcgtaaataataggtgcccgggataccggtattaaccgtcccaacaagattaatatcatcaggactcagcacattacctttactatcagttccaccaagcaaagcaacagctggatcaaagtgttcttttgcctgaacctgaatatcttgagtctgtagcgactgcttgctgttctggttcgtttcttttgaagtcgtgaccgaagcgctagcaggcgtaacggttggtgcatacgtggtggctgaggaaggtgacgatacagcactggatgtagtgactgtctggtatatctgagttggttcacggctggcaaccgattgaacgccagccactgacgcgatggattgtggttgcgctgcttgtgaggcagctggtgttgccgccgaactagctgccaccaccggcttacttaccggcgcttgactcacctgagcatgtgctggttcttgttgagcagccggcttttgttcatgcgttcccacttgatcaatcgcggctgccactcgaatcgtttccggtgtgactgaatcagccttaacagttttgcccgattctaaggcaccggcaccgatgaccgtgacaataagcgatgatgcaaagagccaccgttttccttttttccaagagcggaaatgtgtgcgcctcatctgaatccgattggtattatcaggcccacttccttgattgcttttcaaattaaaacacccctttttcatctacatctgcatcatcttgatgtcaccttcacgaattcctaaaaatgactcgattaatctttagttgtattagccaaacgcgtatcacccagaaaatcgcttttagccggttgtctctagaattggtgaattgacgatgctcctgtagcaaagatcaaacttgttactttgcgcaatatttccaaatcaaaaaccgttcgacaattttttgactggagcattttccagcgctcctctttgttaacgatcaagttggcaaaagttttcttagcaacaccctaaggcgctgcacgggttggatgttgattagtcttcatattaatggcttcctttcagttaattaatcttcgcgatgcttctttttgcccatggctgctagtgtccccatcagtacaatacctgctagtgcaagcaaggcagcttcttcagtttcaccagtttgcggaagtgtgtgtccacttccatctttagtttgcccacttccgtttttagcgatgatgtcagcagttgtaccaggattggttttatccccaacgctggtgtcagtagcaactgtatgaacggtgttgtcctggctgcctgagtttgcacctagttcagaatgtcctacgtcttggctttttggatttttagacgttccgtcaacatctttaacacccttggtatccacatcgtgactggcaatctgttcggcaagatcacgatcagtttgtgcccgggtagcagcactcttggccttatccgccgccgcagtcgctgatgaagcatattgtgcagcgtaggaaagtgcttgagctgctttattcggatcaacataatcgtgtgcaagctcttgcgcagctttactgagtgccgcgaaggaagcagcgtctttagccgcactggcagcaattttcgccgcgttaatcgcgtcggacttcaagtaagctaacgaagaattcttaggtttaccatcagcaaaacttgccgtttcactggccgctttagctgcaactgaagcagctaagtcggctgcggtcgttgcggcatgagccgtgcttgcaaaatcgctttgagttggtttaggcgcagcatcggaacctggcgtgtgcgctgcagcagctgttttagctttatcagcagctgattttgccaaatctgcagaactcttcgcaccggcagcggcactggacgcccgtgagtcgtcacccgacttcgctgcatccttagctgctgcggcagacttggcagcgtcatcagcagcggacttcgctagatctgccgcgctcttgattgcaggatcttctggatacttcgttgcggcagaacttgcttgatcggcactggagctggcttgcttggctgactggtcagctgcactggcataacttgatgcagcatcgcctttagcttttgcttcagcttgggctttggcatcatctttagccttcgcatctccagctgcctttgctgcagcagaacttgccagatcggctgagctcttagcaccggcagcggcactggctgcccgtgaatcgtcacctgacttagctacatccttggctgctgccgcggatttggccgcgtcatcagcagcggacttcgctaggtcagccgcgctcttgattgcaggatcttctggatacttcgttgcggcagaacccgcttgatcggcactggagctggcttgcttggctgactgatcagctgcagtagcatagcttgaggctgcttcacctttagctttggcgtcagcttgggctttagcatcatccttagccttcgcatcaccagctgctttcgctgcagcagaacttgccaaatcggctgagctctttgcaccggcagcggcactggctgcccgtgaatcatcacctgacttcgctgcatccttggctgctgccgcagacttagccgcgtcatcagcagcagacttcgctaggtcagctgagctcttgattgcaggatcttctggatacttcgttgcggcagaacccgcttgatcggcactggagctggcttgcttggctgactgatcagctgcactggcataactcgaggctgcttcacccttagctttggcgtcagcttgggctttagcatcatccttagccttcgcatctccggccgctttcgttgcggcagagcttgctaaatcggcagaactcttcgcaccggcagcggcactggctgcccgtgaatcgtcacctgacttcgccgcatccttggctgctgccgcagacttagccgcgtcatcagcagcagacttcgctaggtcagctgaactcttgattgccggatcttccggatacttcgttgccgcagaactcgcttgatcggcactggagctggcttgcttggctgactgatcagctgcactggcataactcgaggctgcttcacccttagcttttgctgctgcaatcacttttgcggcagcatcgctagcaacggttgcagctgactttgctatttctgctgcagacttcgccgcgtcatcttgaccgtctaacgccgcatacttggcatcattggaggcgcttgttgccgttgaagcagcagatcttgaaagactggttgctgctacaatgccagcatcttcaggatagtttgccccagcactttcagctaactgagcgcttgagtttgctaaacttgcagattgagcagcatcagtagcatagtttgatgctgcgacattttttgccttggctgcatcgcttgttttggcagcagcggtgctggcaacaattgctgcgctcttagctgttgctgcggcagaagacgctttggcatcatcgccgccttgtgcagcactcttagcgtcagttgcagcactcttggcaatatcggctgcagacgtagcaacatccgtattggctttgatgtttggatcattaggatacttagtagcaacagatacggcaccatcagcgctggagcccgcctgaccagcggccttgacagcgtcatcggcaaaacttgacgcagctgttgcttttgctttagccgcgtcacttgcttgtgaagcagcctgactggcaactatcgcggcactcttggcggtatctgcagcttgtgaagctgtcacatcatcgccgacttgggtggcacgctgagcatctgtagctgcactcgaagccgtatctgccgcagacttagccaattcagttaccgccccaattgatgagtcattcgggtacttcgttgctgcttttccagctacattagcactggagcccgcttgactggcagccttagttgcttcattggcataactgcttgcagccgtgctttttgcttttgcagcagcgcttgccttagcagccgctgtgctggcttcggtagctgcggttttagcattagaagcagcaacagaagcagcaatatcatcaccggttcgagctgcacttctggctgcatctgcagcacttgaagctttagccgctgctgcagatgcactatctgttgcagtttgaatttctggctcatccggatatttggttgccgcagaagtagcaacatctgcacttgagcttgcctgactagccgcttgtgcagcatcaccagcaaaactagttgccgccgctttctttgcggctgcgatactatctgctgttttaagtgctgttttggcagcagcttccgcttgatcagcggcagatttggcaatatcagcggcacttgaggcgattgcgtcatcaccgcgagcggcagcgtcttttgccgtatctgctgcaagcgatgcatcttttgcagcttgttgggctacggaactggcacgagaaattgtcggatcatcaggatattgactgcccactgccgttgcaacatcggcactggaactagctaaactagctgattttacggcactggcagcatagctcttagcgtctttgtcatgaaccacagctaagcttgatgccaagtcagctgcaatacttgcctgactagcatgactcttagcttcggcagcggcacttgatgcagccggaatgtcaccgctttgtgcagccgacttagcactctctgcactgtctgaagcctcgtcagctgcttgcttagcgacattatttgcactcgtaatggctgtgtcacttggatatttgactgcagctgattcagcgatatcgccgcttgcttttgcccgatcagcggctttggtcgcatcactgacaagtcgatcaccttgtgttgcgatgttgcccgccaaacgttttgaatcatctgcaacgcttgaggcgatagctgcttgacccttagcctgtagtgcagcgctcatggcgtcatcagctgtactacttgcagcatcggcggctgagctagcaattttggcaaagtttgaagcctgatttgcaaaggtcgaagcttgagacatattgccagctacaatagcgctgttagcttgggaagcagctttgctggcagcaagattggcactacttgttaccttcgccagactgacagcagagccggcagcagctgaggcttgagtggcatagcttgatgcttgaatcgttgcatcattggcagtctttgcaaggctggccagagaatcattgccagggaaccggctggcagcacttgaagcaattgcattttcagacttagccgtgtcagaagcagcactggcaatagcgctggcattatttgcagtggcggaagcttcttgagctacgacagaagcagataaagcactttcgctggcctgactagctttagatgaagcttgatcattggctgcggaaaccgtatccgcaatctgttttgcacgattatttgcgcttacggcttggctggctgcggagtctgctttgtttgcttcacttaatgctttaccggcggcatcatttgccttgtccgcgtattctgaagcaatgtcagctgcagcagatgcctgattattcaggttttgggcagccgtatgatcaccacgttgactggctgccgttgcctgagcagcggctgttttggcagtggcatttgctgaactgacttgatcggcaaagctacttgccgcagatgcatcagcgctagccgtcaaagcataactcgcggcaacactattagcgtctgaagcagctttggccagtgatgctaatgagttgtttgacggatagttacttgctttagccgaggcttcttgataagcagaatcagcaacactacttgcattgctggcgattgcgcttgcattgttcgcaatcgcggttgcagagctggcagtataagcagttgcactggcatcagctttagaagcgacatcacgcgccgtggcagcagcactaacggcaacttttgctttttcacttgccaagtttgcttcgtttagtgcttgatctgcagccgagtttgccttgtcagccgccgaagaagctgtcacgcctgcaatcgatgcttggtccgctaaacttgaggcattggaaaggtcgccaacatcaagcgcagtattagctcttgaagccgcagaagcagctttactgttcgctgcactggcaatcgctgcataactacttgcagcagatgcatccgagcttgctgatttagctaagtcagcagtttcactatttgcagaagatgccacagtggcaagactggttagtgaaggattgccaggataacgcgttgcaatgtttgaagcatcttgatagccggatgctgcgacactacttgcagtgctggcgatagcattggccgagtttgccttaacagaggctgtacttgccacgaccgacgccgaccgcgctgcatcgctggctgcactcgctttatcactagccgcagtattgccgctggtaatggatgaagcaagactcgaagccgcggtgctagctgcaactgcaatgcttgcagcgtcattggccgcagaactggctgcgtatgcctcactcaatgctttggtagccgcatttttacctttgtcagcggcagaagaagcctctgtagcggcctttgaagcacttgctgcatatgacgaagcttccgaaatattgccattcacataggcactatttgcaagggatgcagtttcacttgcaacgccatttgcttgtgaagcggcagtggcataactacttgccaatgaggcatcttcaattgcgcctgccgcataactggaagccaagctaaccgcattgccagctgctgtcgctagagaggcaactgactgatccttcgggaagcgtgttgcaacactagccgcaacgtcaccagcagactttgctttatttgacgcagcgactgcaattgacttagccgaattagccgtgattgatgcagcgcttgcaacaacagaggctgaagtggcaacactagaagctttttcggctgtatcggatgtggctttagcaagactcccggctaattcaatcgcactacttgcagcttgtgaagcaatcgcagcagtcgaattagcctgatctgcctctgtcgaagcctgattagccaaaccgtttgcttgactggcaagatcagctgcactagacgcagcagtcacagcttgtgctttaaagctcgatgcggcttgtaaatcaccaccggcaatggcactgttcgcctgtgaagctgccaagctcgccgctttgtttgccgcgactactttttgagccaaactgcttgcggcagcggcatcagctgctgcacttttggcaaatccagcggttgtgctatttgcacttgaagccactgcagaaaggctggtcaatgacggatctttaggataggtggcggttaacgaagcggttacattgtttgctgaactagccacactgatggcggtacttgcaacggtgcttgcattattagcaacagttgaagcagattttgccgccacacttgctgcgcttgccttgtcactggcggcacttgtttctttagtcgtgtctgacgtcaacgttgcaacccgaccttgtgctgaaagtgcggctttggaagcttcgtcagctgcggacttagcttgtaaggcctcgctttgcgcaagacttgctgccgcattggcattgtctgctagcgaactagccagacttccggcatcttttgcctgactaccaaactttgcagctgcatcattttgccctgctgctaatgcttcatttgctaaagaggcagcacgtttggcaccttcattggcagaacttgtttggcctgcgtaactacttgcggcaaaagcggccgaactggcttttgcagcgtaatccgaagcaacagcttgtgcgctagaagccgttgtcgataaagccgccaacgagctgtcttgtgggaaactacttgcagcactagaagttagatttttagcagaaagggctacggcactggcattacttgcaatggtgctggcattgttagcaacagttgatgcagtgcttgcgacaaccgatgctgaccgggcaacggtactacccactcccgcatcacctgctgcggcagacttcaagttgccagcaatccctgcagcaacagttgctgcgtcagaggcaatggctgcctgagattttgcctgcaatgcataggacattgctgaactagcagctgattttgtctggtttgccaaatctgtcgcgttcgaagctgctgttgatgcttgccccgagtacaaagcaacgccagcggtatcaccggcattggcagcgctagttactttattcgctgcttcctgtgcttgggaatttgcatcacttactcgagtagcaagatcgctagcctggcttgcaaaagcgctggcagacgtagcaaagcttgaagttaagctagctgcctgtcctactttaactgccaaactagcaagagaagcattatcagggaatgaagatgcaaaaccggtagccgcaacattggctgagcttgcagtcgtgctagctgttttggctattgcactagcattatttgcttcagccgaagccgacgttgctgctgtataagctaggctggcgtttttactgtcagctgcagtgctgccggtagtcgtgcctaaacttgcggagagtttggctgcttcacttgctgccgaggtgacaattttggcattttcactagctgcaagtgctgatgctaatgcattggatgctgcagtactcgtttggtctgctagttgacttgccaatgatgcagcactagaagcgatagtagcgtaggaagtggcatctggtaagttcttcgcggccagagcgctattagtttgcgcaactgctgaaatgaccgtatcatttgccgattttactttacctgctaagtcacttgcttgtgagttgctagcaaaagcagatgcagcgtaactagcggtcatcgatgttgcagtcgaagcggttgcagaaagttttgcaagcgattcgtttgttggataggcacttgcagctttgtcaaccacggctttggcagaagttgcggtatcatttgcagcacttgctatggcactggcgctgttggcaaccgtcgatgcaaggttggctttatcatacgctttgcttcctgtgtccgcagccagactggcattgctttttgcagctgcagtgctactggttgagccagcaatcgttgccgctgattttgccgcatttaaagcgtcctctgctgctgaagaggcagcgtttgcttcagatagtgctttatcagcggcggagtttgcaatcggtgcttgttgactggcagttgcagcagcatcagcagcctgcttggcaagtgaggttgcttcatcggtttttcctgcagcgctggcagctttggcggcggccgctgctgaagacgcagttgcgttggcggcattgacagtcgcgactgcctgtttggcaaaggcagcatctgagcttgcagcaaccgcataacttgaggctactgccgctgcactagatgcagtttttgaaagatctgcaagtgattggttgtcagggtttgctgtggcaagactggcaacttgatcactggcaccattagcagcaccacttgccgagctggcgatactgcttgcggaatttgcctttgttaatgcgccactggcagtaacagccgcactggcagcaatagcagcatcggaatcaggattgagcgcggactttaccgttaccaggaaatacgaaaatagtgtcccattgaaaggtccaactaagggttttgtctgatttgtattaatactgtattggacagcgtaaacgcctggtgttttatacgaagagcctgcgatccagattggaacattcgcatcattgggtctgccaacttgactggcgagcatatcgccgaccgtcccggcactgttttggaaggtcaagaaaggtcctaaaagaccatcagaggcaaaaggattaagtggatgcgtatagtcaatattatttgccgcggtactacccgtaatgacccaattaggtgcaagtgtaaaggttgccaaactaccattaccaaatgcggtaaagtttgaatcgacaactttatcaatggaagtatctccagcaaaaatggaaacattgggcgacgtaactgtagctgtaccgcgaggatttgttttcgtaaaaacaacggtgctaggtgttcccgcatcatccaccactggcatcgcagcaagtgtttttgatacaaccacgtttttggtattgttgttttcggtttcggaacttgcaggtgcagcagcttgagttacagcagttgaagtggcactactagtggaactgcttgctgcaacggtaataccggcagctgccgaagtagtcgcattgctggactgaaccgctgccttagcaactggcgccgcacttgatggcgctgcagacgaaacgactgagtttgtgccagaactgctcgcttcagtcttggcaaccggtatttccgcggacgcaacggcttgttgtgtctgcggttgcttttctacctttggctgtgttgttgtggtcgcaatagccggcgtagcattagtaaccgttgcggcgtcagtggccggagttgcggtagttgctgaacttgaagctgtactaggtgctgttggagcagtatgaatcgacgctgccgtttgtgcactggcagcatcaatcacccgttgattgtcatttgaatcggcatgaacggcctgattcccggaaaagacaaatccggcaccaccggcaagaaacgttaaggtgctaaaggtgaaaagccagtgtttcccagctttatacatcttgaaattagccgttttagtcgatggttttttcttaatgaactttcccatgtgttcaccccatttaaagagaaaaaataaactaacgatactttgctcatcattttttgatgctgggtgctgatagcatcaactgtcgcaaaaacttttttgccggattagcagtactatgccgacaaatgttataagctcgttattcccttgtcatcccccttatgattaaaagtgatattattaactcgaagtaccaattttatgataggcattaaaatggtcctcgaattgattctaaatatatatcatgacgattgttataacaagcccacacttttattaaattattttctaaataatgataacccctttataccggtctttaaaacggtaacattagcttttggcttcgtactaatagggtattaaaataaccattatatcattttttctaaaatagtttataataaatcgagtacaattaaagttcaccagtcttaaacttttttagcatctataatgttctaatataatagtttcaggtttatttccgcctttataatcaaccgattaactccttctacttattaaagactctcttgctgtaaaattttcattaaatataaattcaactttgtgatagccaaggaagaggtaaactaataacgaacaaaaagcctgaatccttaacttacgggattcaggcttatgccaattatcaaatcgatcatttttcttaaaacgctaaccaatatgtcatgcatcacggtactgcttttctgttaattaatgatgcttaactcatgaattgataccagctttcaataaccttaacgtctcgcgattgtcgcaactgcttagcaacacttgaaaattgttggcttattaagaacacgctggtactcattgtctgcaacgcttctgcatctgcgccatcatggacaatcggtataaggtgagattgcatttcaggtagttgcactaaggcaggaaagatctcacttgaaacatcgacgtaaagtttgcggtcggtatgcacaaaattgttaaccagccaccaaactaagatctcattcatgtctgtaaatagtttaattggttcgcccgcagaattgtttaaccaatattgttgcgtcaacggtaatccgttaacaacggcgacaccgcttcgatttaggatcagtccctgaatgctcgttgtttgaaaaagcggttcagtcaaggtcatgcgttgcagattgggcatttgcgcataatagtccgatacgaataagcgctcatgatcatcgtactgatcttcgcgcgttaaccgaccatctttaaaatagctgatttgccgaacccgctttttcctatcacgctcgatttttagcacaacttgattctcggcatccatatatcgggtgttcttgctgccaggaactgttttggccgttaagtgtgcttgtagctgacttgccaagttggcttggggactgataccacttccacgatgatgcagttcatcataaaagttatgataggacgtcggcgccaaaaatagctgcttcttgtcgcggtaattcaagaatcgtgccgtggcatcaagttcaagatcaccggttataacagcgggactgtgatggttagttttgaagaagttcatcatcactttgatcttagcccattgttcatccggcatttcttctggcaacaaatccagataaagataatcgcttttagcgtcatcgaatctaaggtcattcgtcccatccgcaatcacttcatcccctgaaggactttcttgtttcttcccaaaaaagttcatgaagctttcccccactcgttttgaaaatgtttctagtacaatcgcaagtagagtatcgcataatcattaaattggcagctattattttgacccgttcacagaagatttccttttggtgatgcttaataactgcgactcaatccgcttaaaatgccgaatgtaccatgccgtggctcagcgcaagcgacctaaaaacgccgtcaaaaactgcaatttctgctgtgcctgcttgaacacctctgactgatacgttgtcagcacttcttcgccaaaagatcggtgggcaatatattggtcataccgcaactcaatctggatcgcggtgacaccttgctgatgaccataatagcgggtaatgtcaccgccacgaaaaggaaaattgtcttcaaccgtccaaccatacgtcatgaactgatccgctaacgccaagcgaaaccttttgctagatgtccgatcatgatcattgccgagaacaatcgtcttgggcttcacgttcggataataagggtattgggcaaagctgtgtaaatcaactaaatacgcatacctaaattcagattttttctggttcagcaaggtcgtcaacatttgacgataaggccgataatatgagcaaacccgcgcctgtatttggggaatcgtcagcggctgtgcatacaggttatgatcaaacgtgttacgctgataaacggttgccgagcgatagtcatgctgcggatcataagtcaccgcccgatttggatcagcgacataccggttaacatgattgattaaagtcgtaaatccggcagcaggcaaaaagtcatataattccggtaaaaaccaatccgtgttggctaaaacggcatttggcaacaatgcttttttcatcgccaccggtatccacgttccgctgtgaggcaaactaatcacgactggagaatgttgctccgaattcagcacggtatataattgattgctaatatccatctaccttggctccttctaaaacagtccgatcatttgactgccttcacgtctataacaacctcgcaggtgccatcatgactaccactaccgcataaaaacagcaccgaacaaccacggtccgatgctgactttctgttttgcttgacgagtgtcgcccgccaattgaagttaagattcacgatgcccttcttcaggcaaaagaatcgtctgactctccccatcatcgtaggccataaccgtatccggaaaactgggatcatatggaaacggcaaatccacggacatctcggtttgtgcgccttcttcgctgaaatgaatcgtcaatttgccttgatggttctgaagatcaaaacgcaacagattatttagcggaacaacgccttgtaagttgcgatcaatgatgagccaaatactgtcgatgatctcgcccggcaggtttgaaataacgccaaaagtcgcgaatcgactatgatttgctgcaaacatatgcgactcctttcttcagtcctgcgtggcaatatccgcaaactcggcatcaacaaactttgctaaaaccttgggatcaacgccaacagaacgaccgattttaccggctgacacaatgattgacgactgactttcggcttcttgactgatgtaaatcggatacttgtggcgctcatgaatgccaataggtgtgttggcgccgtgttcgtaccctgtcgttttcatgagatctttcagcggtaccatgccgactttgcgattaccggaaaccttactcagctttttataatcaacatgccgatctaacggcacaacgccaatcaccggtcccgtcttgttccccgttagtaccagggttttataaatctggtgttccggaacatcaagatgatcaaccgtcaactgcgccacatcgccaacttcttcagtcggaaattcataaggcacataggcaatacccgctttgtccaacattttttcgaccaaggttttatctgtcttatgatgtttagccattgcgatccctccttacgaaatttccattcagacgctttcacttaaaagtctagaacaaggctcgcgaaaatgccaccatcatgcgccggtgtaagacattaacgtgaacatatcataatctttgatcttgtcgcgcccatgcaaatcactgagctcgatcaaaaaggctgtcccgactacgacaccgcctaattgctcgactagacggattgttgctgcaatcgtgccgccagttgccagtaagtcatcgcataccagtacccgttgtctcggtttaatggcgtccttgtgtaagtaaagtgtggcctcaccgtattcaagatcatagctggctttaacggttggccgcggtaatttgccttttttacgtgccggtgcaaagccgattcccagcttatacgccacaggacaaccaacaataaatccgcgggcttccgggccgacaatcatttcgacccctttgtcttgggcataggcggcaatttcgtctgtcgcagccgcataagctttaccgtcagccatcaaaggcgaaatatcgcggaaaataatccccggttccggaaaatctttcacactggcgatgtaatctttaaaattgatggtcatgatcctacctcactgtctgaatgctctgtcaccaacatcgtttcaagctgaacccgcggcatggtttgcagttggcgtgcaagcgttaaaaatgcctcgcgcgcaacataagctttggcggtttgcaatggctttttagccggtgccgtgacgggagaaataaaagcaccctctattgtaacaaaatcaagctcgaaaaacacctgaatcaccaagatcacttgatggacagtcaaatggacggccttggcaatcgccggaatatgatgcttgtcaaagccgggatgtgcttttagaaaatgcagaacagcaccaaattcacttcgcgtcggcattgccactaaccgactgggtgcaccataaaacatgaccgtcaccggcagttgaatgtgctgcataaccgtcaccaactggccacgatctttaggcaagtcaaccaaaaccgcatcagccagtgacgttgtgacttgctcagctagcatggtcggcccaccaaacgaaaattgatgttcgaattgttgtttgacctttgcatcaaagaagacgtaattccgttgcgccttgaattggctcccatcaactgtcggcatccgccagtcaacgacttgaggctgcttgaccgcataatccttcagcatgagttgtaagctggtatttccttgccaggtgttctgatccagttgaacggctaatttaatagcttgagcctcagctaatgttgccgctgcagacccaaaaccaaacccgatgacattgacgccttgatcaatttgaaatctaagatgggcattttccttaccgatcggcttcacattctgaaccacttggggacgcacggaaaaagtcggttccggattaccttgtccaaatggggctagctggcgaattaattgataatgctctagcgttaagtcgccaacttccagacgcgcagcaatcggaagcgctggcttaggcacggtcttgagcatggtggcagcggctgcttccatttgcgcatggatggctgatagttcagcggttttagccgttaacccaactgccatatgatgcccgccaaaatgaaccattttgtcctcagccggttccagtgcgttaaacaagtgatacgctgcaatcgaacggccagaaccttttgccgtgtcgccatcatcggcaatgttcataatcaaggttggtttaccggtagcctccaccactttactggcaacgatcccaacaactccttcatgccatcccttactggcaagcagcagcgttttagccgcttgattttccggcgtctgggccatggtgagagcctcttgcgcaattttgctgaccaacccttgccgctcctgatttaacttgccgacttgttgggccaagtcggcagcgacatcctcttcaaaggtagtcaacaatgtcaccccgggattcgcatcacccattcgtcccaaagcattcagccgcggaccaatcacaaagccaaccgtggtttcattgactgtgtccggtgccacgccggcttcttttaaaatggcggcgagtccgacgcgcggttgcgtttggatcattttcaatcctaactgggcgatgatccgattctcatcggttagcttaaccaaatcggcaatcgtgcctaatgctgccagatcaatgctctctagcggcggctcgccaagtaaggccgttgccactttgaaagcaacacctgcacccgaaagatcgccaaacggatagtgcccctcaggatggcggggatggacgaccgctacggcatgcggaagtgtttcaggcaactcatggtgatccgtaaccacaacgtccatgccagctgcttgggcgggatcaatgacatctgcaccggcaaccccgttatcgactgtaatgaccaattgcgtgccggttttttgcaagtaggcgtaaacttccgcattgggtccatagccgtcagtaaaccgatccggaataaaaacatcaggctcggcacctaggctttgcagggtctccaacatgatcgagctgctggttaagccatcaacgtcatagtcaccataaatcgtaattttttgattttgctcaattgcttccaaaatcctggcaaccgctttatccatatcgtgtaaggcaaacggatcgtgcaaccgactaatgtccgggtgcacaaaggcttcatactctgccttgtctttgatgccacgttgccacaacaaagtcgccaaaaacggcgggactgccaatgtctggctcaattgttgtgtcgttgccggatctggttgttctgcaagttgccatcgatactgcgtcatatgttttcgttcctttctaaccgattcagtataccaaacaaacccgtttgaattaaccgcttgcgccaagttttcgtcaacttagcaaaaggggcggccgtttccgctaaccaacccgttcaggtcatcaaaagcgtgatataattaagttgttaacaagcccaactccagtcagcgacttcaaacaggcaagcagttagtgctgtattgccgttattagacaaagcgttaccgtgtgatcttagtccgcttgactgtgaccggtcatggtggactagctctttttcgcgataacgacttaaggaggaagtaccatggcaaaatctcaagaccaattcaatgaaaaggcgggcaagaagattacagtttccgatgaggctgtcgataaggccgccaaaaaaattgaacaggtcggctacgtaaccgaaaaagacgttccggaaatgatcgatcgcgattatacgcgggcattgtcaaaaaaggtttccgctaagctgcaccaagacaaagacgatgactatttctacgaggaaccttttgattatgaaaatggccgcattgccaacatcatctgggatatggataaaatcaaaacccgtgaagaagcaatgaagaccttagcaaatgaacttggcttgactgttccaaagattgtcatgcgcaaagtcgatgaacaggttttctaaagcaaattctaaaaaatcggcgctgtttaccagtgtcgattttttattttagtttgcttgtttgctagcagcagtctttgtgtccatgacatcaattgcctccaaaaagcacctaaccaagccaggttgatttttttagtgtgacaaccatgcagatacgtgctaattatgtgataatgatgataaagaaaggacgtggaagccatggctgaccaacaagtacttgacgatttttttgcgacggcgaaagcggcattggatttacccgctgtcacttacgaggatgcctatcaacttggcagccctgaactggcagatgaacttgctgacctggttaaagcgggcaagaaaactgcgacttcaagtgggtttgagctttataccatcgagcaggacccattaccgatagccggcgtctacaacattatccttgatcgtcatgatcgaccagtggcgctgactttcacggataatgtctttatcacgccatttgaaaaagtcgatgctgtcattgccaaacgcgaaggtgaaggctcccagtcgttagcaagttggcgccgcgcccatgaagccttcttccgccgtgaatatcaggcaaatggccttcaattcgatcccgaatcctcgatggtcgttatcgaagaatttcataccgtttatccggttgttcaaacgaggtgacaagtatgcggctcaaacaacgaacaacattagctgaaaagaaagtaaccggaaaactcgaagacattccgcatccgacactagatgccaccatctatgtcctcgtttttggtctcaccgcaatcggcgggctggtctcttatggcgcgtatcaactgtttaagcctgaacgccaactcgcccacaaagcaaaggacatggttcaggagcatcgcaaagactgataaaatcagtaaatcaaaaacaggcacccagtaggctgactattttgcctcttgcgtgcctgttttgtaaccacaagtggaatattcaccataaaataacaatttattagatgtaaaactgcctacatttaaagctcatgttggcaaaatgttggcaagaaatcgctaatgattaaaatttcaccagtcaaaacttctcgagagcgctatttaccgcgactttcttcgtcgttcattttaagaatgctcataaacgcctcttgtggaacctcgacagacccaaccgccttcatccgcttcttacccgctttttgcttctcgagtaacttgcgcttccgggtgatatcgccaccgtaacatttggccaagacgtttttacgataagctttaaccgtactacgagcgataattttattcccgatagcagcctggatcgggatttcaaactgctgccgcggaatggtggttttcaggcgcgcaacaatcgctttgccgcgttcaaaggcgaaatctttatgaacaatggtgcttaatgcatcaactggatcaccattcagtaaaatgtccattttaaccagatcactttgccgatacccgatgatctcataatcaagacttgcatagcctttggtactgctttttagatcatcaaagaaatcgtaaataatttcggacaatggcaattcgtagatgacattcacgcgatacttatctaaataatccattgtcacaaattcgccccgtttacgttgtgacagctccatgaccggtccgacataatcgttaggtaccatgatcgatgctttcacataaggttcgcggatctctttaatctcacttgcatcgggcatttcagccgggttgtcgatcgttttttccgaaccatctgttaacgctacctgatagtccacgctcggtgcggtcatgatcaaatcgagaccgtaatcgcgttccagccgttcctgaaccacatccatatgcaagaggcccaagaacccacaacggaacccaaacccgagtgcctgggacgtttccggctcaaattcaagcgcagcatcgttgagttgcaacttttccaatgcctcgcgcaagtcattgaatttcgcgttatctactggaaacaggcctgaatagaccattggcgtgattttacgataccctttcagcggggctgctgccgggcggtctgccagcgtcaccgtgtcccccacgcgcgtatcctgaatcgtcttaattgaggccgtgatataaccgacatccccgaccattagaaaatcgcgtttcactgctttaggtgacatcacgccgacttcagtaacctgaaactgcttgccattgctcatcagctggatcgtatcgccgaccttaacttgtccttctttaacccgaacatcaaggacaacaccgcgataatcatcataaacggaatcaaagatcaacgcttgcaacggcgcgttaacatcgccagaaggagccggaatgtctgagacgatgcgctcaagaatttcaggaactcccaagccggttttaccactggccaaaatggcgtcagaagcgtctaagccgatcatctcttcaatctcttctttaacaacatcaggctgggcactaggcaagtcaaccttattgatcaccggaatgatttcaaggtcgtcatcaatcgccaagtacacattagcaagcgtctgagcttcaacaccttgcgtggcatccaccacaagcaaggccccttcacaggcagcaagactgcgactaacttcataactaaaatcgacatgccccggcgtatcaatcaaatggaaaatatacgtttcgccattattggctttatagtgcagttcgaccgcattgagcttaatcgtaatcccgcgttcccgctcaagtgccatatcgtccagaacttgcgcctgcatatcccgcttggcaatggtgtctgtcaactccagaatgcgatccgcaagcgtggatttgccatgatcaatatgggcaataattgaaaaattgcggatatgcttttgccgttccagcatttcttcatgattcatataaatagtgcctactttctaagcgatcgtttggttcttattatagcagagcgtatcggacacgggtagaagctggtatttaacgaatcaagcggttaaggcctcatacacttgcaagcctggctgcttaagttggcatcattataaggttcacctagacgctgatacgtcaaaagtgctcaccacattaaaaaaatcggccttaacttctaagaccgatttttcgatatttggaccagttttgtgcaattgatagtgactaggcgtgtaacctacttaccgcctttaaacgcttctttaacacggtcaaacagcgtcccattgtgtggtgtgacatcttcaccactagctgctgcaaattgcatcagagcagctttttgcttttcgtttaagtgcttaggtgtttgaatctcaacggtcacaatttcatcaccggtaccgttaccgcgcagccgtggagcacctttaccgcggagtctgaatttggtttgactttgcgtgccggctggaatttttaactcaaccggtccgtgaaccgtgtcaactttgatttcatcacccaaagctgcctgagcaaaacttaacggaatcgtcaggtagatctcggcgccatcacgttgatacttcttgcttggcgcgactcggaaaacgatgtataagtccccatatggtccgccattggttcctgcttcaccagcttgttgcaagcgcatttgctgaccgtcttcaacaccggccggaactttaacatcaatcgtatgccgttcctgttcgtgaccggtaccatggcaggttgggcacttttctttaatttctttaccggttccaccgcagacatcacaaacttggcgggtcatcattgcgccaaatgccgtattgcgttgtacctgaatataaccgctaccatgacacttgtggcaggttaccggactggttcccggtttggcaccactaccatgacaagtatgacaaacagcttcacgatcataggaaatcttggtatcttttccaaaaatcgcttcttcaaaagtcaaatccatccgatactgtaagtcggctccttgccgcggtgcagaagggttcgcctgtgcaccaccgccagcgccgccaaagaattgactgaaaatgtcgtcaaagccgccgaaaccgccttgaccgccaccgaagtcactaaacccgccggcttgaccaccattgccgaatccctgcggaccatcagcagacccatattggtcatatgcggcacgcttttggggatcagacaggacctgataggcttcgttgacttccttaaacttttgctcggcaccgggtgcgtgattaagatcgggatgatattttttggaaagcttgcgaaacgctttacgaattgtatcatcatcggcatcccggctcacaccgagcgtctcataataatctttctgatccgccatagttcctcctcgattcagatcgtgactgaaaatgccaacttagcatagcataattcaaacaaaaagccaaaaccgcgccgcggcttcggctttttgctaatgaactgatgccttatttcttatcgtcgtcggaaacatccttgtagtcaccattaatggtgtcatcatccgacttcttgtcatcagccgtaccttgggctgcgccactcgttgcgccaccctgggcttgttgattcttttgggcattttcatacaacttaacggtcatatcctgaaccagcttgttcaagtcgtcccgcttttgcttcatgtcatcaagattgttttcctgttgcgctttcttcagtgcttcttgcgcatccttgactttcttgacatcctcttccggaaccttgccgtcaacatctttcagggtcttatctgtctggaagagtaattggtcgacatcgttcttcaaatcgacttcttctttgcgcttctcgtcggcttcagcattttcttcagcttccttcttcatgcgctcgatttcttcgtcagacaagccgctggaactcttgatcgtgatgttttgtgacttgccagtaccaaggtcctttgccgatacctgaacgatcccgttcttatcaatgtcaaacttgacttcgatttgcggaacgccacgtggtgctggcggaatgtcggtcaattcaaagcggccaagtgtcttgtcatctgccgccattggacgttcaccttgaagcacgtgaatatcgacagctggttgattgtccgcagcagttgagaatacctgactcttagaagttggaatggtggtgttgcggtcgatcagcttggtgaagacaccgcccatggtttcaatccctaatgacagcggcgtaacatccagcaaaacaacatccttcacgtcaccggaaatgacaccaccctgaacggcagcacctagcgcaaccgcttcgtctgggttgatgctgtggtccggatctttgccagtccattccttaactgcttgttgaacagcagggatccgtgttgaaccaccatttaagattactttgtcaatatctgcattcgtcaatttagcatctttcagcgcattttcaactggcaccttggtcttagcaaccaagtcggcggtcatttcgtcaaattgtgcacgggttaaagtgcgttccaagtgcaatgggccgttggggccggcagaaataaatggcaagctgatttgcgtctgggtcacaccggaaagatccttcttagctttttcggctgcatccttcaggcgttgcattgccattttgtctttagacaggtcaatgttgttatcctttttgaattcggaaacaagccagtcgatgatcttgttatcaaaatcatccccgcctaaatgagtatcgccattggttgacagcacttcgaagacaccatcacctaactgcaggatggaaacatcaaatgtcccgccgccaaggtcgtaaaccaaaatcttttcgtctttgtcgcctttatccagaccataagccaaggctgacgcggttggttcgttgataatccgttgaacattcaaaccagcgatcttaccggcatccttggttgcctgacgctgactgtcgttaaagtaagccggaactgtgataaccgcatctttaaccggttcgcccagatagtcttcagaaaatttcttgatgtactgtagaatcatcgctgaaatttcttgcggggtgtattctttatcgccaaccttaactttatagttagcttcgcccatgtgacgcttaattgacacgatggtatccggattagtgatcgcctggcgttttgccacttcaccaacttggatttcaccatctttaaatgcgacaacagatggcgtggtgcgattgccttccgggttggtgatgatttttggctgattgccttccaaaaccgcaactgcagagttggtggttcctaagtcaataccaataactttactcatatttttataccttctttatttcagattaattatttagcgacaacgaccatagcagggcgcagaacccgatccttgagataataccctttttgtaacacctgcgcgaccgtgtcagcgggatgtttgtcgtccgccgccacggtttgtactgcctgttgggtattcggatcaaacttgtcgccagcaccatcaatcgcagtgatgccattttccttcaaggcgcgttccagatgatcgtaaaccatctgcacaccttttttgagtgaggccgcactgtcatctttggcttcggttgcaagcgcacgctctagattgtcaactaccggcaaaatcgccttggctaacttctggccgtcatatttcaacattttttgctgctctttttcgaaccgcgcattcatgttttgaatctctgcagctgcgcgcaaatacttgtcttcgaatgcatcacgctcttgcttcagttgttcaccatcatgcttgctggttttcaattgctcattaagatcagcaatgctttcctgcagaatttcttcttttagcgaagtctctggcgtgtcagcagcgtgcttggcgtctttggcggtatctgcagcagtctgctttgctttttgttctgccatggtatcctcccttttaaccacatctattcgcgcaattggttcacgttaacagatgcttgttatcatctatcattgatcaaagttggcgtaatagtccgtcaaccgtttagccagctcctctcggaaaacatccaacagtccgatcatcttggaatacggcatctgggttggccctaatagggcaatcattcccgtgccgtggtcaccgacatcataactggcggtaatcaagctgagattggccagatcaattggctttaactccgggcctagacgaaccgtaaccggcgtttggcgaaccggtccgccaagcagttcagtaagatcaccatgatcagcatcaatcaaggacataatctttttcaactcgtgaatatccgagtcgccgagatagtccattaaatttaagcggccacccacatagaaacgctctgaagcggcggactttaagacattaccgaagatatccaggaagccttcaggactggtcagatactgcatcagcatcgacggaacatcagtctttagccgctgagcaacttgaataagcggcaaaccgaccagctgatcattgacaatgcgaatcgccttttccagctcgtcagatgagatgctttcaggaacggtgaaaacctgattttcaacattgccgttgttcgtcactaaaatcgccataacctggtgattgcccaacggtacaaggcgaaatccggtcaatttaatgttattcacttctggccctaagctgatcgccgtgtaactggtcagattggataaaatctgcgcactttgcgccacaatttcatccatcttattgtagcgttgaccgaatgcttgcttgatcgtggctagttcacggtgggaaacacgcactggctcgaccagatgatcaagatagtagcgatagccttgagtcgagggtactcgaccggaactgctatgagtcttggtgatcaaaccggcgtcttccagcgatgccatatcattgcggatcgtggcggaactgacatgaaccggcagttcctgcattaacgtcttggaaccgaccggctgcccactttcagtaaacaggcggatgatttcttttaagacgagcaattgccgtttcgtcaacattttctcacctcacctttagcactcgttttacacgagtgctaatacactgaataatataccaagcgccgttagcaaagtcaaggtaggattgctaaaatgttgcatcaaacagccaactacggttagatttttggtcatatccgaagcatgattcatcattagaccagtggctcatcaagtaggaattgttggaaaacctcatttcccaaaaacttaccgcgattcgtcagtcgaatataaccattttggcgctcgattaacccttggctttccagctccggaaccgtctcgccataaactgcatcgaccgtcatatgatagcggctataaaaacgatcttcattgacgcctgccatggtgcgtaagccaaggaacatttcttcctcaatttgctcagaaaccggtactaaatgatgggccagaaccggtaaatggtcggcatgcaacggtgccagatactgtttgatcggcccataattatgataccggtcacgaccaagatagccaaatgcgcctgccccgaagccaaaatatttatcattttgccaataaagtagattgtggcgacattggtaccctgttttggcaaaattactaatttcatattgatgccgtccgtgagcttccattaaatcaatggcatcttggtacatatcagcttcaacgtcttgcgtcggcaaccgcagcttcccttgacgcatcagattataaaaaatcgtcttgcgctccaggatcaatgaataggtcgagtaatgtggcaagtccaatgccaaagctttttgaaggctgttcaaaaagtcatcgcggctttgatctggcaggcggaaaatcaaatcaatcgacaagttgtcaaacccgacttttctagcattgccgatcgccgtataaacatccttcgctcggtgaatccgaccaatgcgcttcaagacatcatcattaaacgactgcacgccaatcgacagccggttaaccccaaagtcgtataagacctgtaacttgtcggtggtcagtaagtcattgggattggcttcaaaggtaaattcaccgtgatcaaaatgaagaatatcgcgaataccttggcacaaaacggcaagctgttgcggtgtcagcgttgttggggtgccaccgccaacataaaccgtttcaattttttcttctggatgctctgccatcaccatgcgcatttctttgagcaacatggcgacataatcatcgaccggctgaccttcaataaacaccttattaaaatcgcaatagtaacaaatatgctcgcaaaacggtatgtggatatatgcgcctgccatgttaatccttcctcacccgaaaatattggcgaacggtttgttcatctgtctttaactgcgcaatcaaagcatcggcaccggcaaacttgacctcaccgcgtaagtagtggtaccaacggacttgaaccgttttaccatagatcatctggttaaaatcaagcaggttaatttcaagcgttaccgcccgatcatctccaaatgtgacattgcggccaattgaagccattcctaagtaccaagtatcatcaactttgacggtcacggcatagatgccaatacccggaagccgttgttgccccaaagtggctaaattgatcgtcgggaagccaagtaaacggccgcgtgcttcaccatgaaccactttgccagttgtcagatagacatagcccagtaactcgttggctgtgtcaatgtcaccacggtctaaggcatctcgaatacgggtcgaactgatcttcttgccgtcctcagccagcttagggacactgacgacttcaaagcgaccgcgcgcatattccggcaataatgccatattggccacagcgcgtttgccatacgtatagtcaaaaccggccacaaccgcagccgcttttagcccgaccaaataatcatcaacaaatgcttgcggcgataaagcagcaaatgctggtgtaaagtggacaaaatacaatagatccacgccaaattgctgcattaaggcaattttttcttcgcgtgtcgataaataccgaatcgccgttttggcaacgccacggtacacgatcgccggatgcatgtcaaatgtcatcacagcaagtggcagttttttttcaagggcaacttgtttacccgcttgaatcaccgcttgatggccacgatggaccccgtcaaagaagcccaatgttaggacaatgggctgcggtggtgccgctgatgcctgcagtggcggttgaatatcaatgactttcattcaaatatcactcattcttttcattcgttaaaaacataatatcgggtcgatactgttgatgatccaagcgataaatcgcttttaaaacccctgcataatgcagccgaatccgtggggcttgcaatttaagcgttaaaaaccgaccatgcgtcacatcttcgtattgctccggcgtcaaatctacttgcggtaacgccgcaaatgcgatgtcaatcggttgaataacagcagacagtgtcccgatttttgcgtgttgttccagatccgcaagactcactgcctgtgcgagggtaaagccgccacttttaatccgcgtcaactgactcatcacggcagcgactcccagcgtgcggccaacatcaacggctaaagtacgaatgtaggtcccttttgaaaccgcagcctcaaatttaaatcgctgcgttcctttttccgaatcgaatactggctcactggttcgtttgaattgcttaaccgttacttgtcgttttggccggtcaacggttacccctgctcgggcatattcgtacaaccgtttgccattaactttgactgccgaaaacattggcggtatctgggtgatttcgcctgtccattgcctcaatgcttggtcaagttctgcttgcgtaaacgggttagctaaaggtgtgcgcgttaccacatcgccgtcaagatcttcggttgttgtcgcaaagccgagtgtaatttcgccggtatagacctttccactggccatcaattgtgggactgctttggttgccgcaccaatcgccagtggcaacaccccatcaacacttggatcaagcgtgccggaatgcccgatttttttgatgtgcagaatcttgcgcgcatgatagacagcatccgcgctggtcatgccgactggtttatataacggaagaatgccgttcatgaacccggctcctttcaaattttaaaattaagagacacccgtgcgtgacgatcgcttagccgcaaaccatcagtttcacgacttcggtttggtatacatactgtgatgatgcctggcgtgaacggcatgccgccaccccgcccagataaagatcaccactaccagaaccgaaaacagccagtcaggagtttcaacatggatcatgggaaggctcaatccaagtttgatggcaattaacccaaccaacacataagccgccgtttccagctccggaactcggtcaatgaaagtggtaatcacctgtgcaacgatccgcatcgccagaatacccaagcaacctccgatcaagacaatcaccgggttaggcgatacagctaaagcagctaaaatcgaatcaactgaaaacacaatgtccagactttcaatttgcaaaatggttccccataaaccatgcgttttgtgcttgtgagtggccgtattgcttttagggtgacgcactgcataaaaataactgccactcatccaaacaagatacaaagctccgactgctttaatcggccaaaactgcagtaagtatgttccgagtccaatggcgatgaaccgaaacaagtacgcgccacccatcccgtacattaaggctttcttacgttccgattctactttaagctgctcggtctgcgcggctagaaccaccgcattatcaaccgacaacatacattccagaagaattaaactgaaaatcgtcatcagcccgccaatcgaaaatgctgactgccaattgtgcgcggaaaaaaatggcccgtataagtcacctagaaacgcgatcgtaatccttcctttctcaatggttatcattataccgttctaaacaggaaagctaaaggtgttgagaagaaaggaagctggcaaaaagtagcctcttaaaaagaatgcggtaaattttcggattaaattcgtcaaaaaaaagaacccccatcacttgagacggggattctttaacactactattcgagattcttacggcgtacttcattaatcaactgatcaatccgcgcaccatattggacggatttgtcctgagcaaactcaatttccggtactttaaacaaccgaatacgctgcccaacctcacgccgaatcaacccactggctttatccaaaccagtttgcgctgcttcgactttatcaggcgcatcatcgagaatgctatagaaaatggtggcatgctgcagatcaccggtcagtttgactccggtaatcgtcacgcctttaacccgcggatcattgacatctttcagcaaaatatcgtcaacttcccgttggatctgagtctcaactcgaccgatacgatgtttcatctgcactaacctcctttgagcgtgagccagcccgctgatgaaccggcaaacgcactaaaactacttaactggcacttcttccatcgtgaaggcttcgatttcgtcaccaactttaatgtcattgtagttctcaatggttaaaccaagctcaaacccttgacgaacctgcttgacatcatccttaaaccggcgtaacgaaccaagcttgccttcatacttaacaatgccatcacgaatcaggcgaacacctgcatcacgggtaatataaccggaatcgacatagccgccgacaaccgtcccgacttttgagaccggaatcgtttcacgcacggtgacggttccaatgaccttctcttcataagtcggttccaacatacccttcatcgcagcttcaacttcttcgattgccttatagatgacactgtgcaaacgaatgtcgacatcgtcttgttctgcttgcgctttagccattgcagtcggacgaacattaaagccgataatgatcgcgttacttgctgcagctagggtaacatcactttcgttaatcgcccctactgcctgatgaataatattcacgcgaacccctttgacttcgatcttcttaaggctgcctgccagtgcttcgacagagccttgaacatcggccttgatgatgacgtcaacttctttaagttgaccttctttcatcgtttcaaagaggttgtccaacgtaacgtgcgtcgtgttcttacgttcttcttcctgagcacgttttgcccgctcttcaccggctgcccgtgctgtccgttcatccgcaaagacgacaaacttatctgcagattgcggcacatcatttaacccggtaatctcgactggcatggatggtaaggcatccttaacgcggcggccatgatcgttggtcatagcccgaacccgaccaaacgtattcccgacaacaatcggatcccccgtatgcagcgtcccttgttgaaccagaaccgttgcgaccggacctttgcccttatccaaacgtgcttcaataacagtaccgactgcacgttgatccgggttggccttcaattcaagcacatctgcttccagcaagatcatttccaataattcatcgatattcttgccaaacttagccgagattttaacgaaaatagtgtcgccaccccagtcttcagggatgagaccatattcagtcaactgttccatcacgtgttccggattagcacccggcttatcaatcttgttgacagcaacaatgatcggagccttagctgcctgcgcatggtgaatcgcttcaatggtttgtggcattacgccgtcatcagcagcaactaccagtacaacgatatcagtaatatcggcaccacgcgcccgcatgttggtaaaggcggcgtgcccaggggtatcgaggaacgtaatcaaacgatcgcgcaatttaacctgatacgccccgatatgctgtgtaattccaccggcttcaccttcagtcacatgcgtatgccgcaacttgtccagtaaagtggttttaccatggtcaacgtgacccatgatggtgacaactggcggccgtggctgcaagttgtcctgattcttattttcttcctcgaacactttgtccagatcggaaatatcttcgtgaaccttttctttagcatcaatgccataatccgttgccagaagctcgatcgtatctttatccagactctggttttggttaaccatgacgcctaacataaagagtttcttaattaactctgctggttcgcgatgaagaatcttacccagctcctgagcgttcatccctacttcatagttcagaacttccggtaatggccgctctttacgctgtggcatctcttttttcggttggctctgctggcgacgtttgttcttcttgttgcgtcggttgctgttgcggttaaacccgttacgattcccaaagctgttgccacggccaaaattgttgttcccgccgccacgccggctattacggttgtcttggctaccggcactggctggtttagctgtcgtgttggccacagccggttttgtaaagcgttgattggtttgtgcagcaggctgctcggttcgtggccgctgctggcgctgttcagtccgcgctggtttctgttcggtttgcggacgttgttgggcacgagtcgcttgcgggcgctgttcagtagattccgaacgtttactcgctgcagctggtttagccgcctgttgacgcttaggttgctggcgctcggattccggtttaacaaacttgccaccatttccggctaccggacgcggattaccattggcagcggtcggacgcccagcacgcggcatcgggccagtcacacgctgattgtcaaaacgccggttacgatcccggcgattacgatcgtttgagcgattactattgttattggcggaacgattgttattattgccgcggttattgttacggttaccggcattagcgttggcagtctgctgattgctgtggttgccagccttatgcgcggtctgagtgccccgtggacgtaaaattgttgacttacttaaaatgatttttccatcagcagttttgttagacttagcaggcttgttttcatgcttgaccggcttttcggactggctctgagcatgatcttttgcagttgccgcctttgatttggctggttttgccgctgctgatgttgcaggtgccttagctgcggcagacttgcccagcacccctttgatcttagcttcctgatcctgatcgatcgaggacatatggttttttacttcgatacccaaattcttggcaatatcgagcacgtctttattatcaacgtgcatttctttggcaaattcataaacgcgttttttgcccatttcttcacgctccctgcaatttaggtgagcagctcttgcatcttcttagcgaagcctgcatcggttacggcaatcatcgcgcgatcactgccgatggcttgcgataggtccattttggaaaacattgtgaccaaaggaacttgatagtagctgcttttatcggaaaacttcttgcgggtattggcacttgcatcactggcaacaaagaccagctttgcctcgcctgagcgaatcgcacttaacaccaactgatccccagtggtgagacgactagcgcggcgggccaatcccaataaattcaatacggcttgtttttgcatggttacttgccgaataattcttgacgtgccttttgatgatctacataagcaaaaaggtcatcataaaaggccggatcaatcgtaatgccaaacgcggcgtcaatcaattttttaccttttgcccgtttaaccgcatcaggatcaagcgctacatacgcgcctcgtcctgcagctttaccggtgggatcgattgcgaccacatcttccttgttcttaacgattcggacaagttctttttttggcatcatcgtgttgctcagcaagtccttgcgcattggtatcttacgctttttcatggctcgcctccttatgcctgtggctggtcgtgggtgcttggcgtcacaggggtttcatcggcttcatcgtttgcctgatcaactccagcatcatcactgggcgcttgactggcgttatcttggtcatctgctgctgcggctgcctcaacctctgcttcggataattcatcatcgtcaacgaattcgacttctgattccggcttgatgtcgatcttgtaaccggtcaacttcgctgcaaggcgcgcattttggccttttttaccaattgccagtgacagttgataatccggaacaatgactgtcgccgaacgatcattgtcttcatcattaaactgaaccgcgatcacttgtgccggatttaaggcattagcgatgtaatcagccggatcttcttcccactgtaccacatccatattctcgccagaaagctcattgaccactgcctgtacccgtgcaccccgcggacccactgttgtaccgacagcatcaaccgcatcgttggttgcccgcaccgcgatcttcgtccgatcaccggcttcacgcgcaatgttgacaatttccaccgtgccatcgaaaatttccggaacttcctgttcaaacaggcgctttactaaaccaggatgggtccgactcacaaacacttgcgggcctttgctggtattttcgactttggtgacataaaccttaatgcgatcgtgagcttcatacttttcatttggcatctgatcttgacggcctaataccgcttcgatcttgcctaagttgacgtagatgaaccgattgtcccgacgctcaacgacaccttgaagaatctcatcttcgtactgtgagtattcatcataaacgatactgcgctcagcttcacgcactcgttgcataatgacttgttttgcggtctgggcagcaatacggccgaagtctttgggcgtcacttcaaacttgatttgatcgccgatttcataagctttattgatagctaaagcgtctttgagactgacttccagacgcgaatcaaaaacttcatccgtcacttctttgaccgcataaacatgaatgtcgccttgtttaggatcaaattccacatcgacattttgggcctgattgtaattacgcttataagcagaaaccagtgcggcttccaaggcttcaatcacaacctctttcttaacccccttttcttgctcaagggcatcaagtgcttggatcatttcctttgacatgcttttcttacctccactaaaactcgatcgccaatcgtgcagaagcgatcaattttcggtcaatgacctgatcgaacttgcggcttttatctttgaccgttaatgtcagctggtcaggcttcaaatctttcaaagtaccttcgaaaactttcttaccatccagcttcttaaataacgagacatgaatgtagtcgccgattgcctgttcataatcggtctcgcgttttaacggccgttcagctccaggactggagacctcaaggaaatattgttgcggaatgggatccggattgatagcgtccaattgctcggacaacgcttcgctaaccagcacacattcatctaatgtaatgccgcctggcttgtcaatatacacccgcagataccagccgccgccttccttcacaaattcgacatccgtgaggtaaaaatgatggtcgtccaaaatcggtttaaccaaagcggtcacggtttcaacaaccgattgcgtactcaagccaccgcctcctttattgttcattcaagactattgattctgacggcacgctaaacggacgccagaaatgacgttcgccaataaaaagagtgagcatcgctgctcactcaccgccagaaccttactttactattgttacaataccatagataggcaccacttgcaaacaagcaggtcagtgtggtaataggcttaccggccattttaatatctctgcacgataagcatcaagcaaaaacatttatgtggccgaattaaaataagccatcaaaaagtgataattgattttcatctggaagatcatctaaaacatggttggtcgtcatgtaatcaatcaaagttttagaaacctttccgcgatttgctaggtcttcttttgataagaatggcttttcttcacgggcagcgacaatctgcttggcaacgttatcgcccaatccgggaaccgcacggaatggcgctagaatggtgtgatcatcctgaatcaggaaatcatgggaatcggacttggtgacatcaatcattttgatcttaaagccacgctccaggcattcgttagcaatttccaaaacagttaacaattgcttttctttagcggaagcatccatgcccttgtccgtaatctccttcattgcggctttaacggcttctttgccgtgactcatggcagctaaatcaaaatcttcggcccgcacggaaaagtaagcagtgtaatacaccagcggataatggaccttgaaccaggcgatccgcaatgccatcagaatatacgccgttgcgtgggctttagggaacatgtatttaatcttcaggcaggaatcaatataccaatccggcacattttcattttcgcgcatcgctttttgccagtcatccgggataccccggcctttacgaacgtgttccatgatattaaacgccatggaatcgtccatcccccagtgaatcaagtccatcatgatgttatcacgacaaccgatgacttccttcaaggtgacaatgccttgcttgattaactcttccgcattgcctaaccacacatccgtcccgtgagacaatccggaaatctgtaataattcgctgaaggtcgttggcttggtttcttcaagcatgccgcggacaaaccgggtcccaaattcgggaatgccaagcgtgcccattttggaattgatttgttcaggcgtcacacctaaactctcggttccggaaaaaagcgccatgactccgggatcgtcagttggaattgatttcggctcaacccctgacaagtcctgcaacatacgaatcatcgttgggtcatcatggcccagtacatccattttcaaaatattatcgtgaattgaatggaaatcaaagtgggtggtcatccaagcagcattttggtcatccgccgggtattgaatcggtgtgaaatcataaatatccatatctgccgggacaatcaagatccccgccggatgctgaccagtggtacgtttaacgccagtatcgccttgtgccagtcgatcaatttcagcaccgcgcaactgttgaccggtgtcgcgctcgtaagctttcacataaccataagcggttttatcggccaccgttccaattgtcccggcacggaaactatgatcttcgccgaacatcactttgatatagttatgcgccacaggctgatagtcaccggaaaagttcaagtcaatatccggcaccttatcgccgtggaagcctaagaacgtctcaaatggaatgtcatggccgtctttatgcagctcggttccacatttcgggcaggtcttatccggaaggtcaaagcccgatccgacttcgccatgcgtaaagaattcactgtactggcatttcggacaccgataatgtggcggcaatgggttcacctcggtaatctcggccatcgtcgcagctaaactcgaaccaaccgaccctcgggaaccaaccaagtacccgtctttgttcgactttaataccagccgttgcgcaatgttataaatgactgagaatccattcccgataatacttttaagttctttatccaagcgttgcgcgacgatttctggcaacggattgccgtaaagctcataggcagtcgccatcacatcatgtttgagcttttcttccaccccaggcacttccggcgtgtaaagcttatctttaaccggtgtgatattatcatcaatccagtcggcaattaaattcgagttggttacgaccagttgctgcgccttttcttcgcctaaccaactaaaatcatccagcatttcccgggttgagcgaaaatgaacatcaggcagactatgacgattaagcggattggccccaccttgactgtgaatgagaatctttcgataaatcgcatcgtgttgatccagataatgaacgtcaccggtaacgacaaccggcttctctagttcgtcgccgattttgacaattttttgcaaaatatcttttaaatgcgactcgcctttaataagatcggcttctagtaatggctggtaaacggctggcggttgaatttcgagataatcataaaatgctgccttggcacgtgcttcagcctcccctttttgcatcatggcggtgaaaacttcgccgcttgagcaagccgaaccgacgagcaaaccttcacgcaacttctgcaactgactgcgtggtactcgcggcacccgatagaagtatttgacatttgacaaggacaccaacttgaaaagattcttcaagccggcttgggttttggcaaatacaatcgcatgactcgggcgggcagccttataagcctcaccggcacccacgcgatcatttaattggttgagtttggtcatgttgtacatcttggcagcttctttttccaaggcgtatagcaaataaccggtcgcctcagcatccgcgttggcgcggtgatggtgttctaggctaactttgtattgcttagccaaggtatccagtttgtgatttttgcgttcgggatggagcatgcgcgataactcaagcgtatcaatgaccggattgtcaatatcagccagcccgtgccgctcataaccattatccaagaagcccacgtcaaacgtgacattatgtccgaccatgatcgcaccgtcacagaactgctggaaaagccgaaacacttcttcttcagacttggaaccgtgaaccatgtcgtcggtgatatgcgtgaggttaatggttaattctgacagcggaaaaccgggatcgatcatttcttcaaactgatcaatcacctgaccgtctttcattttaacggcagctaactcgatgaccttatcgtaaactgctgaaagaccggttgtttccacgtcgaaaacaacatattccgcgtctgccaacacgcgcggctcgtcagctcgataagcaaccggcgttccatcatcgactaggttgatttcaacgccgtataacattttcaaaccggctttagcagctgcggtgtgggcttctggataagcttgcagcccagcatgatcggttacagcgatcgccttgtgtccccatgctttagcgcggttcacgaaatcggtaattgagttggtcgcatccatctggctcatgtttgtatgcagatgcagctcaacccgtttttcgccttcaacgtcatcggttggatcaggatgggaaacggtttgaatatcttgtgcattgatcgtgagttcgcgcgaatagttgtcctcttgcacactgccgcgtacccgcaaccactggccttttttaatgcgcgcaaacatcgcctcatcgtcagcaccattgctgaatttcttggcaataaaactggagctgtaatcggtgattttgaaaatcagtaattgccgtttcgagcgtaattcccgtacttcgacatcaaacacatagccttcaacggttactgaacgttcttcttgggtaatcgtgaccatttgctgcggcggatcactcatttttaactgccgccccatttgaaccggaccattcgtgggctcctgtttttgtttagccgcttgccgcttcaccacttcagcagctgcctgggccatcttcgccgtttgcgctgctttttgcgcttcaaatgccgccaaagactgcgccgcttgctcttcgtctacttgggcctgcatccgtaatccggaaaagccgacttgctgataggttgcttcaagcttacctaatccttgattaatcaggtattgccgaatctgttcattttcagctgttatcaccgcgcgattattcaccaacgtcggtacctgtttttcgcacagttcacgaacgatcccagtaccgatttctgaattttgcaccacatatggccaatattgcgccaatagttcgtcagtaatcgtcggctgagcaaccgcaatggtcaaccgtgtcgccgcaatttgtttgaaagcaattggcagttgcgtggcgatggtattaaaaatctggaatggcaaaatcgtcggaaacgccaaggtaaagtcatagcgttgtgactgctcatggattgtcactgcttgaaccgacccatctgccagtgatggatcatgtcgcacatctgctggtaaatcgagctgatccattaatttttcaaacatctcatgttgggataaagccaaatcgtgcacccctcttagatggcagaaactgggacaaaatgctgccaactcttcaggccacaaactcgccgccaaaaagaggatgggattagcaattttgccccagcgccttagttatcaattatgcttttgcctgttcttgtttatgcaactgggccatgaggatcttgatcgaactgatcaactcttctttcttgacttcaattgtttcgccagtcttacgtaacttaagctcaacaatctcatcaaccgcttttttaccaaccgtcacgcgcaacggaatcccgattaaatcggaatcggcaaatttcacacccggccgttcgttacggtcatccaccagcacactatagccggcatcttcaagcatcgttccaatcgaagcggtcagcgtcttttgttcctcacgcttcagattaaccggaatcagatgaatgtcaaaaggagcgatcgtggtcggccaaatcaagccgtgatcgtctgcctgctgttcagcaattgccgaaagcagtcgtgatacaccaataccatatgatcccatgataatcggctgactacggccattttcatcaaggaaatcagcgcccatagtttcagaataccgggtaccgagtttgaaaatatggccaatttcgatcccgcgcgtaaacttaagcacaccctggccatccggtgacacttcgccttccttaacaaaacgaatatcggcaaaagtttccggattcacatcgcgctcaaagttcacgttcagtaaatgtgtgtgcgctttattggcacctgccaccaaattcgtcaagccgctcagactattatcggcaataatccgtacatctttatcgacgtttaccgggccgatattaccgacttctgcgtgcatgaccgattcaacctgttcaggagtcgccatttcgaggaagtcagcgcctaagatgttcttaagcttggtatcattgatttcataatcaccacgcaccagtgccagcaccggagcaccatccgccataaataaaacggctttaattaacttttgttccggaatcttcaacaaagcagcaacttcagcgatcgtttttgcatctttagtatccacccgggttaattccgcctgggcttcaacgccttgcttcggcagcgccatgctcgtggccatctctaagttagcggcatagtcggaactgtcggaatagacaatggtatcttcaccaattgacgcaatggcggaaaattctttcgagtcttttccgcccatcgcgccgccatcaccgataatcgtccgataacgcaggcctagacgatcaaaaatattggtgtaagcatgttccatttgccgataaatggtatcgagatcctgatcattactggtaaatgaataagcatcctgcataatgaactcacgcccacgtaaaacgccatagcgcggccgatcttcatcacggaatttatcctgaatttgatacaacactaacggcatccgcttgtaagatttcaattcattgcgaaccagatccgtaaaggtttcttcatgagtagggcccaagatcattttacgatcctgacgatttttcaacttaaataaattgggtccgtaagtttcataccgtccggattcttcccagagctcggctggcaataacgccggcatcttcatcttaaccgcatcgatcttcgtcatttcatcgtcaatgatcgcttcgattcgactcaagacgcgttctgctagtggtaaataggcataaacaccggcttgcacctgacgcacaaagccagagcgcaacatcattttatgtgactttgcctctgctgaactgggtacttctttttctgtaggaataaacatccgtgattgtttcatgtcagcctccaaagctagattatttaaaagtaacgcataatatcattaatcgtcacggcgagcatcaggagtaccatcaacccgaggccaaccatggtgacaacaccttctgtttcaggcttcaacggtttgcgccgaatcagttcaatgagattcagtaaaattttaccaccatccagaaccgggattggcaacaaattgctgattcccaagccgagacttaagtatcccataaagaatagcaatccctgcaatccacctttagcactttgactggtcatggtataaattccgaccggcccagctaacttattaagcgaaaagccgccagtcaccatggatttgaggacatcccaagtgcgcacagctaaatcccaggtttgggtgaaaccatacgtaaacgcccgtgccggtgatttttcgatgagtgcttccacaccgatcttgccatccttgttaggcttgatgaccacattttgcgttttgccatgctctttaactgtaaacgtcaccgacttaccggcctgtttgctgactttgctggaaagatcagtaaaagaatgaatcttttcaccatcaatcgcctgaattgtggcatttgacttaagcccggcttgagcagcaggataaccgggcagtaccgttccgatttgattggtatttaagacctgcacgccaaacatcaacccgtaaataataaaggtcaaaatggcaagaataaaattattcatcggaccggcaaagttaacaattagacgccgccaaaccggggcattttgaaattggacatcttctggcgcaatttgaacttcggtgccatcttcttcaataatcgtggcatcatggtcaaccgaccaacgctccagtttctcttcgtcgccattagggtagccttcaatcaccaagtctttaacgaggtctacgcggcttacttgtaccggcatgccacctgccagcgttgttttatcactggcattaatccgcgtcactgtaccggcatcattcaggataatactcagcatggtcccaggcttgatttcatcttcctcatcctgccagccagccatacgtacatatccgcccagtggcaacaagcgcaaggtataggtcgtattattcttatgtgaggcccatagcttaggccccatgccaatcgaaaactcacgtactaatattccgctgcgcttggcaaaataaaaatggccaaactcgtgaaccaccacaagaatgcagaagataacaataaaggcaatgattgtggtcatatgtgctccttaatggtcagacaatgccaaacaaatgcagcattggcaataccagtagtaaactgtcaaaccgatctaaaataccgccgtgccctggaagaattttaccggaatccttaaccccgtaaaatcgcttcaaagcggattcgattaggtcaccgatttggccgataaccgacaggcacaaggcaatccccatcattggccaaaaagtataatattgcgggaagaacattaagtaaatcgcagccgttattaatgcaagtacaaccccaccgacactgccttcgatggttttgtttgggctgatcgccggccacaatttatggcggccaagtttgcgaccgatcatataggcaccagtatctgtcaaccagacaatcagcagcgcaaacatcaacgtatccagccccgcatcgttgcgcacactgatcaaataatgaaaccctgtaccgatataaaagaatgacaacaccgatacaccaatatcatcaaacgtcgtgcgattcttggttgtcacggttatacaaagcaacaaagcaaccgcaatgtaaatcagatcaatccgccctaaaaaggcaggcagccaacggaaaaagctattcggcaaaaccaccgccaagataccaagcgatgcaatcagaaaatctggcgaaagaatgatgcgcttccgcatgatatacacttctgataacgcaattagcgctaagactgctccggctgtatcgatccaaccgccaccggcaattagaattggaataaaaattgccaaagcaacgacagccgttatgacccgttgtttcatgataacaaatcctccatcaccatttatttagttgattatttttttaaaccgccaaaacgccggtctctagcctggtaagttgcgatcgccgcctccaatgcagcaggcgagaaatccggccaataatcatcgacaaacaccagctcactataagcgatctgccagagcaaaaagttggaaatccgtaactcaccacttgtacgaatcaataaatccggatcggctaaatcaccaaggaaccccgtcatcagtgcagcagaaaaatgctgatcatcaatatcttcaggatctaattgaccatcacgcaccgcgcttgccagtttccgggcagcgtgaaccagttcgtcacgaccaccataattcagcgcaaagttaagaatcatgccggtgttgttggccgtatccgccatagctttttcactcgccttgcgtgtcggctcaggtaagtcggttaactcacccataacttcaactttaacattttctttgattaaatcaggcataaaatcgttaaaaaagtcaaccggtaagcgcatgaggtaattcacctcagaaccggggcgcttccaattttcagttgaaaaagcatacaaagtcaaaactttaaccccgagacgacttgctgccttggtaatcgttttaacattttgcatgccttgtttgtgtccggcaacccgcggcaacaatcgccgctttgcccaccgaccgttaccatccatgataatcgcaatatgcgcgggaatccgtgccggatcaagtttcactttcgaacccttggctatggccaaactggcgcctcctcacaacgtctacggtgcctcatgcaccaaatgtctttaacgattgtagcagaaaaaaaggcagagcgcgaataggcgcggttagaaaccggagtgtaagcggccttaaagtgaaatgaccgggctttggtcattttgctttaaggtccttacattccgatttctgcgcctattcgcgcgttttaaaaccgaggccaggcgcagttagaagtgaagtcgcaaatgcaaccatttaacaggacaacttttaccactagtttcctttgttagcatgattacatggcgccaaaaagtttattaaaccagaaaaaccccagatctatgaagtgccccataattgttagacagatactctaatgatagtggggtatttttatgactaaatattcaagtgagttcaaggtgaaggttgtacaggagtatctttctggacgggtttcctataacagcctttgcactaaatacagtatcccgtcaacgaaaccagtccgagagtgggttaagcaagcccaagtccatggacttgaatctcttcagcgaaagcatacgaagacattttattctctggaacagaagctggccgtggtagactattaccaaaccagtggtgcgggtgtggtatctgcggctgctcatttcgggatcaatgcctcgcaggtggctgtctggatgaagatcttcaagactgagggagtggctgggttgcgtccgaaaccgcgaggaaggcggtctacagtgaaacataagaaacccaaacaagttaagaagcttgagcttagtgagaaggaagcttaccagcaagagatcctgaaattacgcggcgagttataccatacgcgaatggagcgtgactttttaaaaaaattaggggccgtatcgaagaacaatctgccgcccaaaaaacagcagtagttgacgcgttacggcatgactatccattgaaggaattattggcattggcacagttgcctcgggctactttctatgaccgcttgcaccgcaagaataagccggataaatatgccgccttgaaggtatttatcaagaagaccttccatgactcatatgagacctatggctatcgccgtattcatgtgatggcacgaaaagccggctttaaatgctcacccaatacaattctacggttaatggggcaattgaatcttagtgtcacactgtattctcgccatactagcggctatcactcctataagggaaaagtaggcaccgtgaacgacaacctgttacaccaacaattcgatgcccaggagcccttcgctgtcctgcacaccgacgtaacgcaagtcagactgcttgaccacagctggggctatatctcggccatcattgacgaggccagtcgagaggttattacagtcattgtgcgcaactctgcgaacaaagaacaactccacctaacgcttgacgatttggccaagaaactccccgctggcgtcacacccatcatgcactctgaccaagggtggcaataccaaacccgtgaataccagtctcaggtgcacgccatgggcatcgttcccagcatgtctcgtaaaggtaattgccatgataacgcaccaatggaaagcttcttcaacctactcaaacgagaacggctcaatcggcaaccaatcaaggatcttgaggaactgaagcaaatcgtagatcattacgtcacgtggtttaatcatgaccgtatttcactcaataaaaatggcctgaccccgattgaatatcggaatcagaccgctgcgtaactaattttccaactgtctaacttttttgttgcacttcactactctgaggttttcattcaccaattaaaataccacgctaaacttcggtaatttccttttccttagctgcagcaatttcatcgatgcgtttggttgcatcgtcagtggctttttgcatatctttttcaagtcgatgcaattcgtcttcggtgatgtcaccgtctttttcctgtcgctttaacttatcaagtccttcacggcggatattacgaactgcgattttggcgttttcagagaacttgccgacttctttggcaatttccttccgccgttcacccgtcagctgaggaatgaccaaacgaatcacatcgccgtcattggcagggttaatgccaagatcactggcgttgatagccgtttcgatgttcttaagtgatgatttgtcatatggactaatctgcaaaacccgtgcttccggaaccgtgattgccgccatttggttcaatggcgttggcgcaccgtaataatcgaccgtaatctgattaagcaagctggcattagcacggcctgcacggatgttgcctagttcacgctgtaatgattcttcggttttacccatattgacttttgcttgttcaataatttgatttgccattagcttctcccttcgattgtggtgccgattttttgaccttccacaacccgtttgatattgccgggctcgtttaagttaaagacaactaagtcgatatcgttgtccattgacaaggtgctggcagtcgagtccatgacttttagatccttgttgatgatgtccatgtgtgtcagactctcatacttgacggcattggtgtctttatttggatcggctgaataaacgccgtcaacattattctttgccatcaggataacctcagcgccgatttctgctgcccgtaacgctgcagtcgtgtcagtgctgaagtatgggttaccggtgccgccagcgaaaataacgacgcggcctttttccagatggcgaatagctttacgccgaatataaggttcggcgatttgccgcatttcaattgacgtctgaacccgagtcggtacaccttggctctccaggttatcttgcaaagccaacgcattcatcaccgttgccagcatccccatatagtcggcttgggcgcgttccattcccatctcggcgccggtttcaccgcgccagatattgccgccaccgcacacaatggcaatttgtacacccagttcgtgcacctctttgatctgttgggcaattttggcaatgactggtggcttaatgccaaacccagcctcgcctgccaatgcctcaccgctgatctttaaaatgatccgtttatatttgaccatgtatcttatacctccgttggttgctggcactattttaccatagtcgcagagtttctgcggcaagaagctgttgctaaccgctaagttttaccggcaattcggctgaatatcaaaaacattcataggctgtcactgtcaactttttctcagttttactctaataggtaaactccaatagtctgagctggctattcgtcctcacataacgcgctcccccgacgcaaaagtctgcgtgtaaggacctcagtcgcaatggccaaagaccggccatcacgcctgaggccacttacactccgacttctatccgcgccggctcgcgctcagccataacgcgctcccccgacgcagaagtctgcgtgtaaggacctcagttgcaatggccaaagaccggccatcacacctgaggccgcttacactccaacttctaaccgcgccggctcgcgctcagccataacgcgctccccggcgcaaaagtctgcgtgtaaggacctcagtcgcaatggccaaagaccggccatcacgcctgaggccacttacactccgacttctatccgcgccggctcgcgctcagcaaaaaaaagacgctgccacagagacagtgcccttttcttgtcattaacccttgatctggtccatgacttcatctgcgaagttttcttgtttcttttcaatgccttcgccgacttcataacgaacgtagcctttaaccttgccgcctttagccgcaacgtacttggcaactgtctgatccggatccttaacgaattcctgatcaaccagtgagatttcactcaaccacttgttaacgcgaccttcaacgatccgcggaacaattttttccggcttgccttcgtttttggtttcttcagtgaaaatgtcggtctgatgttgtaattcatcagctggcactttactacgatctaaatattcaggattgatcgcagcaacatgcatagcaacgtctttggcagtggcatcatcggcgccatccaaaaccgtcagcgctgcaatttggccaccattatgcaagtaggcaccaaaatgttcattgtcggtcttggtcacaatctggaagcgccgcaagctgatcttttcaccaataacactggtcaaggcgatggcaccttcatcaatggtctggccgtcgctcatcttggtggccttggcagcatcaagatcagctggcttattagcagcaatcgcagcagctaccttgttaacatagtctttgaactgatcatttgaagcaacaaaatcggtctcagagttaacttcaacaattgcggcagtattgccgtcaactgcgatttccgctaagccttcagcggcgatgttgccactcttcttagccgcttttgccaagcctttttcacgtaagacatcaattgccttatccatatcgccatcagctgcaaccaatgccttcttagcatccatcatgccgacttgggtacgatcacgtaattctttaacttgtgcagcagtaatttgagccatggatctgatcctccttgattgtaaaaaagctgcctgcagatcttgcagtatgcgaaaccctcagacagcttaatgtttaattaattagttagcgcgcttgttgtcgccttcgacagcttccacgatatcttccatggaatcagccttcttgtcggcagccggttgttgttcctgatcatcttcttgatcttcgccttggttaccttcaataatcgcatctgccatcttggaagtaatcaaacgaacggcacgaatcgcgtcatcgtttgaagggataatcacgtcaatgtcatcaggatcggtgttggtatcaaccatcgcaacaatcggaatgttcagcttttgggcttcctgaacggcaatcttttctttgcgtggatcaacaatgaacaatacgtcaggaatccgtggcatatcttcaatcccgccaaggaacttctcaagcttgtcttgttgcttcttcagaagagaaacttctttcttaggaaggacatcaaaagtgccatcagttgccatcttcttgatgtctttaagccgtttgattcgagtctgaatcgtgttccagttggtcaaagtgccgccaagccagcgatggttgacgtaaaattggccggcacgggttgcttcttcggcaatcgcatcctgagcctgtttcttggtcccaacgaacaggaaaaccccgccgttttgtgcttcttctttaacgaaattgtaagcatcgtcaatcatcttaacggtcttttgcagatcaatgatgtagataccgtttctttccgtaaagatatacggcttcatcttagggttccaacgacgggtttgatgcccgaaatgtacaccagcttcaagaagctgtttcatgcttaatactgccatgtgtttgttcctccatttggttttattcctcttgacgacgtcgcctcgcagatggacttcaacagaagcaccccactcacgatcagtcagtcaatgtggtttgtgcataccgcactcgataaagtataccgacttttcatcactttgacaagccctgccacttgacatgatgcgccgacaaaaaaagttctttacgacggcggctctgatgtttaaaatgccattccgccgacagcgcttcgtgtttgtccgcaaacgcttcatgatacagtaagcgcacggggcggcgagaagccgtatacttggctcctttgccagcgttatgtgttgccacccgggctgccacgtcatccgtaaacccgccataaaacgtcccatccgcacatagtaaaacataaaagtaatacggtttagtcgccatgtaacagcctcctgacaaacggcgtataaccgccatcagcttcatgaacaatcagcggtggcataatccgcaaaccatccggacgaccggctttaatcgcggcaatcaagaccatattggcttcccggtcttcacgcggatgaatgaattgcagctgtttaggtgccaatccgaccgcggtcagcgttgccaataactcagccagccgatccggacgatgcacaaagtaggctttcccttgatatttcaacaaatcagcgcttactctcgccaccgttgcaaaatcagtcgtcaactcatggcgcgcgatggccagatgatcattaggattcgtaatactccgggcactgatcttgaaatatggcggattacaggtcaccacatccactgaatccttggccacaaacttggtagtgtccgccaaatcaccttcgtggacgtcaacgttagccaatgcattcaacgccacactgcgacgcgccatgtcggccagccgcggctgcaactcaaccatggtcacgcggttatccgttttacgcgccaagaaaagccccaccgcaccattgccggcagccaagtcaaccacccgactgtgccgtttaatctgggcaaaatttgccaacagcaccgcatccaatgaaaaagaaaaaacggccccgctttgaataattttaatgtgccgactagcaagcacatcaacccgctcaccaggcaataatgacatctccaacacctttttcctaaaaagctaaaattcggcaaacagccttccgtgaatcgcgataacagatgaaatcatagcacacacaaaccgccactagctacagcttttcagtctggtggttcgcgctccattataaaacgggaggaagccaatgctaaccgattaatggtataatctacatcaaaagtttaaccacgaaggaagaataagccatgttttatagttttctgcgttacgtcgttgccagtttaatctggctcataaacggacactctcaaacccaggagaaacaggaattgccggatgggccgtttgttctggtcgcgccacatcgttcctggctcgatccggttttcctcgcacttgccgcttggccgcaccatttttcatttatggctaaaagtgaactgtttaaaaatccattgctccactggctactggtgaaagtcggggcctttccggttgatcgggcgcatcccgggccgagtgcgatcaaggttccggttcgcgcattgaaacaggaaggcaaagcgttgatgatctttccaaccggttcgcgctattcggcagatatgaaaggcggcgcaattttaatcgccaaactggcaaaagcaccgattgttccagcagtttatcaaggtcccgggacgttttggtctctgtttaaacgcaaaccgattatcgttcggttcggcaaacctgttgatccgccaaaaggaaggctgactgatgaagcgcttgctgctttcagcgacgagctacaggaaaattttgctgctttggatcatgcgattaatccccattacaaatacgttcctgataagaaaaagtatctggaagaaaaagaacacggagaagtataaggttcgcttgtcgagcctttttcctttgttaccaaataaaagaaagcgagtaagttaatgaagctttggaaacaaatgacccgcaaaccggatttgcaagctgctcttaaagccgatgacttgttgacccgcagcctgacaacccgcgacttgattgcacttggcattggcgccgttattggtaccggtatttttattttacccggcaccgtggccgcaaccaccagtggcccggcgatcacgattgcctttattttggccgccatcgtatgctcactggctgccatgtgttatgccgaatttgcttcggcgctgcctgtcgcaggttcggcttatgcatatggcaatattgtgtttggtcaggtattcggctggattatcggctgggcattgattcttgaatatatgttggcggtagctgctgtctcgactagtttctcagcttattttgccagtttgctttccgggtttcacatcacgctgccgactgctattgccggtccattttcacctagtcacggtacgtacattaatctcattgcggtgatcgttgttttgctgatcggcatgatgctctcgcgcggcatgcagtcatcgatggcgattaaccggttaatggtactggtcaagttgctcatcatcctaattttcgttgtcgttgggttcttttatgtgcagcccgccaattggcacccttatatgccgttcggggcaaaaggcgttcttgccggagcggccttggttttctttgcttatctcggctttgatgcggtatcggcctcggcacctgaggttaaacagccgcagaaaacgttaccccgcggcatcatcggtaccttaatcatcgcgacaattttgtatgttttggtcgccattgtcttgacaggcatggtgccgtttaccaaactggacgtagctgatccggttgcttttgcgctccgcgttgttcatctacgcggtctcggcgggttcatttcggtaggcgcgctggctggcatgttcaccatgatggtcaccatgatttatagctcatcccgcctgatttatgcgatcgggcgtgacggcttgttaccacgctggttcggtcatgtcagcgggcacttaccggaaaatgcgctgtggacagtggttacggtgattgctttgatgggtggcttggtgccgctaaatcagcttgtcaacttagttaatattggaacgttaattgcctttgcgtttgtttcaatcggcatcatcccccttcgtcgccacgaagccattaacaatcagggctttcaggttcccggctatccggtgacgccgattgtctcatttctcttttgcttgttgctgatgacccaactaagtgccgagacgtggctgatgagtctggcttggtttgcgtttggattagtcatctatttcagctacggcattcgtcacggtcacgtgtctgaagccaaaatccggtaaacgttaaagaaaggataatgaacagtggtcaataatcaaacggcaacctgccttgttgatggtcaagtttacgcgatcagtgatggccttttcttaagcgatcttgaaaccaaactggtcaatatcattaaaaacgactatccgcgcgcgaccaaaaacagcttcatctgcaatgcgcatctattaaattaccgacttgagcgcatgcgccggcaacaacgccaggatgaacgggcacatgaaaagatcaatcgcaaaatgtcgcaggctttggttaaagatgattttcagctgactgatgtttatgacaacatggagtccacgatcacatttggcgaacggattgccgatgcggtggccaaatatgccggttcatggccgtttatcattatcttttccagttttatgattgtctggatgatcctcaatacggtcgggattttcggtaaacggtttgatccgttcccgtttattctgttaaacctatttttgagtatggtcgcagccttacaagcaccgttaattatgatgagccaaaatcgggcagcggagtatgatcgcttggaagccaaaaacgattaccatgtgaatcttaaatccgaagaagaaattcgcctgctgcattcaaaactggatcatatcattgctgacgataaccctaatctgttcgaaagccagcgcctaaccgtcgaagtgttaggcgaaatggttaatcagctaagtgaaacgcggcagcagctggccttacttaaagccagtcaagacgaggcaaaccgtacgcaacttgacacgaagataaaaaaatagaacatccgctactttgtgcaaaagccaaaagtagcggatgttcttttatatctaagctgccattaccgcgatgcttcctcaccctcgccaacttgcaggtgatacatttcgtaataccgcccatgctgtgcaagtagcgattcatgtgtgccgcgctcgacaatgcgaccggcatctaagaccaaaatcaaattggcatcctgaatcgtggacaatcggtgggcaatggcgatggtggtgcgaccttgacgaatccgccgcagtccttcctgaatcacggattcggtttcggtatcaatgtttgccgttgcttcatccagtaccagaattttaggatcagtcaccaccgtgcgggcaaatgaaatcagttgacgctcgccactcgagaattcacttccgccttcaataacccgcgcgtgataagtgtcgggcaatttattgatgaagcgatcagcctgtacaaattccgccgctgctttgacttgctgatcggtaatctgatcattaaacaggcgaatgttgctgctgatatcgccgtaaaacataaacgaatcctgcaagactaagccgagctttttgcgcaactccggcatcggataatcgcgaatatccacatcgtcaatcaaaatctgtccttggccaaactcgtaaaagcgcatcatcacattgataatcgagcttttcccggaaccggtatgaccgactaacgccaccgtttcgccaggattggccacaaagctaatatcgtgcagaatgtcatgttcaccatcataggcaaaactgacatggcgaaattcgattttgccttgctgaataacggcatgtgcatccggatgttgtgcgggcgcgtattccttgctgtcaagaatccggaaaatgcgactgccggcaacaacgccatcctgcagaaacgacaggttatccatcatgttaaccatgggattgaagaaattggcagtgtaagtggtgaacgcatacaccaagccggcctcgacatagctatgcatggaaatcaggccaaatgcccacaaaaccgcaatcagagccagtgaatatagaaggttaatcaccgaggacagcaacagcgagtttacgcggatcatcgctttgcgggcatcgagatactcctgattcgtcgcttcaaattcccgactaatgcgattctcctgccgaaattgctgaataatcgcaatgccttcaatcgattcattcagttgggtattcagctcagacaatttttcacgcatgtggcggtataccttggaactataagtgctgtaataccagaccactactaacagaatcggtaagaatgccgcgaccaacaaggcaattttaggattagccgcaaacataatcgcaaagctgctgatgaccgagaataacccgacaatgacggccaaaatcacattccaaaagtcggaaaaagtcatggtatcgttggtgactcgcgatacgatcgagccagccggcgtttgatcgaaatagcgcatccccagtgtgtgcaatttagcaaacagttgccggcgcgcatcttccagtccacgttcagcgcccatgttgaacaagaaggtttggaagaactgaaatacggccttaaccagagtaccaaatgcataaagcaccgcaaacagcagcagaatctgaaccgttgcactttgatttgccaaataacgatccatgaaaacctgcagaatctttggcaacagaacattcatccctgccagtaacgccgctgcgacaattgcgccgataaattgacgtttatacggccgcgtataacccatcaaccgccgcataatttttagctgttgccgaaccggaatgctttttgaccaagcgctttcgtatcctttacttgccacgcatttcaccttcttccgctgcttccatttcctgcttagcccacatttccgcataccagccatgcttagctaataactgtgcatgagtgccgcgttcgatcacttggccattttccaacacaataatttcgtcagcatgcatcacggagctcaagcgatgagccgcaatgatcgtggttttgtgcgcccggtcacgtttcatgttggcaaggatctcttcttcggttttggcatcaaccgccgacagcgcatcatccaaaatcaacaattcaggcgcattaatgaccgcccgtgcaatcgccaaccgctgcttttgcccgccggataaactgacccctttttcaccgaccagcgtttcatagccggctgtaaatttctgaatatcatcgtgcacggcactttccttggccgccttttccacttccggctgacccttttcaaacgccgaaaagcggatgttgtccgcgaccgtggttgaaaaaagaaaattatcctggggtacgtagccaattgaatccagcaatgcatccagcgagtaatctttgatgttgtgaccgccgaacttgatgaagccgtcgtagttatcgaattcccgcaataaaagcttaaaaatcgtgcttttaccggcaccgactttacccacaatgcccagcgtattgccttctaataaggtaaaatgcacccggctcaaagccacttgctgatcattagggtagctgaatttgttaatctgataccgaatatcaccatgtgccggtgtcgtaatggcatctttggcttccaaaatcgtggaacgttctttaagcaagtcgtccacgcgatcatagctggcattaccacgttcaagaatattaaatagtcggccaattgcaaacatcggccacaccaaagcggaaacgtacgtcacaaacgaaaccaactgcccaatcgaaatttggctgtgcaccacttgccaaccgccataaataatcgtaatcacgtaagtcagtcccatgatcaaactggtcgtcggatcaaacaacgcatcaataaagttaacccgccgattaatctgaaccgtgtgatcgacaatgcgattgaaatcagccgtgtcctcagcctcttgcccaaatgtcttaatgaccttgatgccactgacactttcttgggttttatcattcaaccgcgaaaaagcagcctgcgactccgaaaacgcagcatgcaaccgcgttcccagtttacgggccatcaccgccaacaatggcatcggcaaaatggcaatcaacgtcaagcgccagtccactaccaaaatcatggcaataatcgtggtgccgccagtaataaatgaatcaaataaagtcaaaatgccggcgcccgcgacattttggaccgcatttaaatcgtttgttgcatgcgccattaaatcgccagtacggtgtttttgatagaaggtggcatccattttcataaaatgccaaaacagccgggtacgcaacgtccgctccagcttggccgccccgccccaaatagcgttgcgccaaccatagcgaaacagatactgcgaaatcccggaaaagagcaaaagccccaacatgaatactaagtgactgctagttaatcgcgatttgctcatcgcatcaactaaatcaccaatcacttttggcggaatcaaattaaccaatgcaactaacagcagaaaagtcacacctagcaaatatcgccgccattcctgcttaaaataccaccctaattttttgaaaattcccacaacacttgctccttaaatcaacgttttgatccaggtttaacaaaccggatcagctgtttatgaaataaatggcttacaatttctcataagcttcggcaataatgaacatcttctcatgatagcacaaacatcgccaggacgcgaaaacgcgacgacaaaaaagaattctgtcatcgcgttttcttagtaattacttagcattacgttgggcttgtttcatttgcgccatcatctggttgagtttcttagcagatggtttttgtcccatttgcatcatcatggtacgcagcatctcttcgttcacaggcggattatcttgaaaatacttcttcatatatgcccgtgcgccgaagaatccgcctgctaagccgaccagtaacgcaatgatccccacaagtattgtgactaacaatgtgcggcctccttcaagtttcatttctcattgtactaaagcgcttcgatgttgaaaagactaatcttcgcgccaaccgtgttcgcgttgaattttttgaacctttttgctcgtgatctcatggccttttttatcaaagacctgggtatgctcgatttgatcacgcaagcccgcgcgaaaatcttttaaataagcttcacgcaatttttgccgctcgattttctcttcaggcgtcaaacccacgctccgatcttttttggcgagttcattaattcgatccaatcgttcttttggttgttctgccatcgtgctacctcctataaacgttctaaactgcaaccggtactattagaaattagcactgaattaattgccggactttggccttgacactatctgcgtatttccgaccggtaaaacgttcgatcatcagttttggtgcatcctgcttagttcagttgaaccgcggtgtagtgataatgtgcggcctcatgattaggataaggcgcattttgcaacatcgcaacatattctgcggcacgccgctgggatgagaaggcttttaacaactcaatcggcgctgactgatccgcatagtagacaacgtatatccattgatcatccataagccttcacctcgagtctgtagctgggtggcttgaatgatgggggttaaaagggtgcttcaggtgagtttatttgtgtttcaccagcgcgggagcttgcatgtaaggacctagaccacaatgaccaagcttacattccagctgaactggagtcctatgacactcccataacgcgctcaccggcgcaggagcttgcatgtaaggacctagccccccaatggccgcgccctacattccagctaaactgggggagtccctgggggagtcctatgatactcctataacgcgctcaccagcccagaaacctgcacataaggaccttggtcgcaatggcaagccacttttctgttgagcctgagtcctatgacactcccataacgcgctcaccggcgcaggagcttgcgtgtaaggacctagaacccaatggcaaagaacgccattgggttctaggccacttacacttcagctcctaaacgcgccggttcgcgcttccaaaaaaaaagaccgtttccggccttttccatattaacgacgcttttcgcggatacgtgctgctttgccgcggagtgcgcgtaggtagtagagttttgcccgacgaacttggccgtgacgggttacttcgatcttttcgacccgtggtgagtgtaacgggaaggttcgttccacgccgacaccgttagagatcttacggacggtgtaagtagctgaaatgccaacaccgtgacgcttgataacaacgccttcgaacaactgaatacgttcgcgttcgccttcaacgatcttggcgtgaacacggacattgtcacctgcgcgaaaatcaggaatgtcgtcgcgtaactgtttcttagtaatttcttgaatcaatgggttcattggtctttctcctttgccgacattcataatcatcccgaccagcggaatgccgttgatatgtgacgtatcacagtcaataagtttagcatgtccgtcttggcgtgtaaaggtaaaattctttacctactcgcaaagtgtcgatcgtaaagaaatggctgccttgtcaacctacactctttttattggctaaagacacgccattccttaatcaacgtcttgattgcttattgttccttttaaccgcttttccgcagcttttgtcgcttcttccgtcttgacttcacgtaacaagcgcatcgcatcctggtcaaggtcggcagcttgtaaaagatcgggtcgccgcaaataagttcggcgcagactttcctttaaccgccagcgggcaatgagttgatgattgccgttttgcagcacttccggcaccttcatcccgcgatattcaggtggtcgcgtgtattgtgggtattccaacaagccattctcaaaactgtcggtatgggcactttcgtcgttacctaaaactcccggcagcaggcgcacgatggcatcaatcatcaccatcgctggaagctcgccacccgtcaagacatagtcgccaagtgaatattcatcggtcaccaaggtgcgaatccgctcatcatacccttcataatgcccacaaataaatacgagatgctctgcttgcgaaagttcccgtgcggcttgttgatcaaacttcttgccagccggatccatgagaatcacccgtttcggtccgggatgccgctggttaacgccatccatcgcctcaaaaagcggttccggcttcaacaacattccggccccgccgccataaggggtatcatcaacatggtggtgtttatcgtgactatagctgcgataatcaaccacatcaaaatcaagcagatggcgttcaagtgctttaccaatcatgctttcccgcaatggttcaaacatattcggaaataggcttaaaacatcaatctgcatcgtcaatcaacccttccggtacgatgacatgtgcctctttttgctcaaggtcaattgtttgtaccactgattttaggaatggtaaaagcaactcacttttgccaggacgcggaatcacccaaacatcattagggccgggacttaagatttcgctgactttgcctaacgtctggccatgttcatcaatcaccgttaagccaataatgtccttataatagtaactgccttcttcaagtggcttcaatgccgcctcggtcacttgtaacttcttgcctttaaacggtaacacctgattaatatcggtatagtctttaaacgtcagcatcgtgagtcccttatgctggcgaaccgagttaatcgtcaaggctgtcttcggcgtggttgcaacatagaccttgttgccaactttaaaccgctgttccggaaaatcagtcgtcaccagtacgcggacttcacctcgaatgccgtgcgtatttacaatcgtaccaatatcatagtaatctggcattttctcacctctgtgtgctgtcgtttctttcaaaataaaaagaccagcgcaatatgcgccagtctttttattttgcatgcggcgcgtccaaaatattgagccgcacccgtttgctatacgggctttttacactgtatacaatggttcgaattgcctgggcaactcgcccctgtttaccgatgacgcggccgacatcttcaggcgcaacagccaaatcgaaggccatatactcgtctgtttcgtgtgccgtcaccgccacggcttctggtttggtaaccaacggggtaacgatggctttaattaagctgccgatatccaccattaacaaccgcctttatttcttggcaaagcgcgcttcgtgatacttctgcatgatgcccttgctaccaagcaagttacgtacagtatctgaaggctgtgcgcctttttgaagccagttcaaaatatcttcttcatttaactttaaatcgactggattagtcaacgggttgtaatagcccacggcctcgatgaaacgaccgtcacgcggcgaacgtgagtctgctacaacgatccggtagaaaggcttacgctttgaacccatccgctttaaacgaattttaactgccactaagtccacctcctgctcatttatcaaccttgatagcatagcaaaaatattttaagctgtaaagccttttttctttacacaggaaattgttctgattatgaatggaatcgcttggcctttttaagccgttttttcttgttccgcttttgcttgcgaaccatggaattcatggccattttgcctagtttgccggaaacaccgccacccataagtccatcaaggcccttcatattgcctttgctcatttggttcatcatttgcttactttggttgaactgtttaatcatgcggttaacttcaacaaccggacgaccggaaccggccgcaatccggcgccgacgactgggattgagcgaatcgggatcttcgcgttctttgggggtcatggaataaacaatggccttcatatgcgcaatatctttgggatccattttgacgtttgctaaggccttgttattggccattccggggatcattttcatgatgtcttccagcgggcccattttgctgatctgatccatttgatcgagaaagtcgttgaagtcaaacgaattttcgcggattttctcagccatttcctgagcttgtttctcatcgtaggtcttttgcgccttgtcaatcagcgtcagcatgtcacccatgccaagaatacggttcgccatgcggtcgggataaaagacatccaaggcgtccatcttttcgccttgcccgatgaacttaatcggtttgccggttaccgcacgaattgacagcgccgccccaccacgggtatcgccgtctaatttggttaaaacaacaccggtgatatcaagttgctcattgaaccctttggccacatcaactgctgcttgaccggtcattgcgtcaaccacgagtaagatatcatttgggtgcgcaagttctttgatgtttttcagctcggtcatgagcttttcatcaatttgcaaccggcccgcagtatcaatcagaacataatcgtttttgttttctttggcagtggccagcccttgacgcacaatttcaacgggatccgtgtccgtgcccatttcaaaaaccggaacattgagttgtttaccaatggtttgcaactgatcaatggcggcaggccggtagacatcagccgcgatgagtaacggccgcgccttttcattctccatcaaatacttggaaagcttgccgactgtggtcgttttcccggccccttgcaacccggccatcatgataacggtcggaatgtgcggtgccttattgagcggaactgccgcctcgcccatcgttttgactaactcatcgttaacaatttttataatctgttgcgccggcgtcaggctttcaagcacttccgagccgacagccttagtccgaacattcttgatgaaggtcttgaccacatcaaaattgacatcggcttccagcaatgccagtcggatctcacgcatggcatcgcgcacatcgctttcactaaccttacctttacgtctcagtccgctaaaggctttttgtaaccgttctgataatccttcaaatgccatagtatccccctgttatttcgcagtttgatccgcgactcgttctaataatgtacttaaattcttgtcacttggataatgcgtgcggacgtagccgaccagcgcatccaccgcctcattttgtgcctggtagttggcaaaaagatgtagtttctgctcatactcttccaaactggcttccgtgcggcgaatattgtcatacaccgcctgacgtgacacgttaaactccgtggcaatctcgcctagcgaataatcatcaccatagtacaaggcaagataagcatgctgtttatcagtcaataacgggccataaaactcaaacaacgagttcattcgataatttttttcgatttccatgatgtcattcctttaatcccatgattgccggtctatcaactacccggccgctcgaacatggtccttgtataaggataccggtatcatttgaaatggtcaattaacgtttttattttgtgagcgtgagccggcgcgcttagaagtcggagtgtaagcggccttaagcgtgatggcccggtcttggccattgcgcttaaggtccttacacgcagacttctgcgccggggagcgcgttatagaaagtgagccggcgcgcttagaagtcggagtgtaagtggcctcggacgtgatggccgggctttggccattgcggctgaggtccttacacgcaggcttctgcgccggggaacgcgttatagggtgcatgtcgtggcaactgagcccgccaccgctccgccagctcttgctttctataagtgccgtacaaaacaaggtgacttgtagggtatctaatcaggcgcaaactcgtcaggatatgaaaccgattacataatgtgctattatacctttaaatatacgaggggtgaactttatgccaaaaacaacgctaactttaacaagcacagattcaaaaaatattgatgatctaatcgttgcagtgatgcagaagcttgatcaaactgggtacggattcttggcgattgcttttgctcaagagctggcttaccaccagagtgatgccgataagctggcgttgatcaaggaatacgtaacaatccaatagttcgcgatttccagttttcccctatttcgtggtacactgaacatgtgaaaaattggagggaagaatatggtcgcaacctttatttactgggccgtctttgctgttcttgctgcttggggattgtggagtttggttttctcatgtgtttacctgagcaaccatgaaaacggcaacttatggttctttgctattatcaatgccatctttggccttttgggctggttgttcgcatggatcatgagtaacaccgcatggcagcaatactggtttgcaagtaaggttcagccatctgcatggtttacttacctgctgatcggttaccttgtcttgattgtcttgcaggtcgtacttggccgagaaaagcaagtccagacagcttaatcattggttcacgaaacgcaaaaatcgtcacacctcaaactcgggtgtgacgatttttatatgcacgccatttaggcatcaacttgaattagacccttaaatagcccagcgacaaatttagtcggatcaaaggcttgtaaatcatccatcttttcacctaagccgaccagcttgaccggaacatgcaactcattccggattgcaagcacaatgccgcctttaccagaaccatctagcttggtcaaaacgataccggtaatttgggttgtttgattgaactccttggcctgattcaacgcattttgccctgtcgttgcgtccagaaccagtaaaacttcttgtggtgcatcaggtaactcgcgaacaatcacccgcttaattttgtttaactcgttcattaagttgactttattttgcaagcggccggcagtgtctaccagcacaacatcataaccttcatctttagcccgtttaaccccgtcaaagacaactgcagccggatcaccgcctggattcgttgccacaaccggcacttcaacccggcgaccccattcctgcaactgttggatggcaccggcacggaaggtatcggcggccactaacaaaacgcgtttaccttcttctttgagttgatgggccagtttgccgaccgttgtggttttgcccgcaccgttgacaccgacaaataagaaaacggttggcccttcttcggcaaaatgcagctgattgtcctcacctttgcctgcttcaccatacatatcgaccaacttttcaacgattactcgcgaaaccgccttgggatccttagcatttttgagtttcacttcttcgcgcaactcatcactaagccgcaccgccgtttcaaacccgacatcggattcgatcagcatttcttcaagatcctcgaaaaaatcttcatcaaccgttcgaaagttggcaaacagtgcattcagcttttcaccaaaactactacggcttttttccaggccttcatcatatttattttcttcaggcgtctccggttcagtaccggtgaacgcttttttaatcgcatcaaaaagtcccattaacttgtcgcctctttctgtgattggtccaaactaacggccataattcgactcacacccgactcctgcatggttaccccatataagacgttggctgcaaccatcgtaccatgacggtgagtaatgacaataaactgagttgcactggcataatggcgtaggaattcgccaaaccggttcacattaacgtcatccagtgaggcttcaacttcatccagaatggaaaatggcaccggccgcactttgagaatcgcaaataacaacacgattgccgtcaatgcccgttcgcctccagacaacagcgataggcgggttaacttcttgccaggcggctgtgcagaaatctcaatgcccgtcgtcaacagatcatccggattggtcaggctcaaatgcgcgtgaccgccaccaaacatctgcgggaagatagcttcaaatgcactatttgtctgatcaaacatggctttaaatctggttttgaccgtttcatccaattcgtgcattgtagcgactagctgttgtttagccgctaaaagatcatcctgctgcttagtgagaaattcgtaccgttcattaacttctttaaattggtcaatcgcatttaaattaaccggacctaattcatctattcctcgcttcaacagtttcaatttgctcttaagctcaggaatcggggcatgatccgccgcaactgctgctttagctgcttcataagttaactgataatcttcagccaaagtattcagccgcgaatccagtcccagtttcacgcgattaagcgccactgcttgctgttcagaagtcgccatcgcctgatgctgctgatcataagtggtcgtgatcctggctgaaatgtcgcttaattttccgcgattagccgctttttcctgcgtcagcttagtttgatcggctttaagctgcgtcagttcttttttcaagctggcaattgttgcggtccggctttccttttctgcggcagtttccttggcggttgccgtaatgtgcgcaattcgttgttgaaactctgttgactgggtttgcgcatcgatcgcttgcgcctgccattgctgctgctgatcatggagcgtttgcagatcattcgcgatgacggctaacttggtctttaaaccattaacggctgctgcttgcttagaacttgagtcagctgcagcaacagcggcttccttaagctgatcaatcttggcctgcgcatcggcaatttctttggcaatcttttgacctgcttgatgcaaatcagccaatttggtactcaaatcagcctgtgcggtattggcctgttgcgcggctgccaattgccgctgcgcctgccgcaacgtctcagcttgggcattatgctgactggtaatggcagtaagatcggctgctaatgcttgcgcttgagcagtggcagtttgccaggcttcctgagccgcgttttcctgtttcgtcaaggtcgtcaagtcagcttgcttttgcttcaaatctgcaactagatcctgcaattgcgttttgagatggcgcgcttcttgattacgcgccagtggtgatgcttgccggccttgcttaacctggccacccgtcagcgagccgcctgggtttaaaatatccccagcggttgtgacgatgcgataccgatgatgtgttgagttggcaataacaatcgcatgtggcaaggtgtccacaattaacacactacccagcaagttcgccatcacggctttcaaatcagctggatactgtgccagttgcaaccctgttcctaaaaagccgtctgcactttcaactaactgcaaaaccgcacttggtaattcccgcggccgcatcaccgcagccggcaggaaggtcgcccgaccagcgcgttgttgtttcaaaagactgatggcgcgttgtgcggctgcctcatcacgcgtcacaatggcctgcaaattactgcctaacgctaaatcaaacgcttgttggtaagcagatggcacctcaagtaattccgcaaccgctccgatgacacctggtaaggaagctttatgttttaacactacacgcacaccattataaaagccggcataatcttcatttaattcggacaaggtttcgtatcgagcccgcgcgcgctgataagtcgccatctcatcttgataagtccgttgctgatcagttcgtactttttgaatttgtgtcagcttgtctttggcttcttgtgccgccgcttgttgttgatcgactttggtttgaagctgctgctgttgattcaatagtgtattaactttggcttcctgatcctgagcctgtttactcagctcataaattcgacgatcatgagcggcattttgactcgccgccagttgctgatctttttgtaaagcggcctgcgcatttttgttatccgcctgggcttttaacaaatcaatgtaatgattctgcaccgtttccaattgccgattaatggctgccggatcttggctggcttgcttttgttgggccaattgcgttttgagctcaagctgtttggcttgagccgtttttgcttgcttagccaaatccgctagccgctggttggcttcggttaacgattgctgcgtatgggccagacgttctttcaaatcagccagagtcgttgctgcattagccgaccgttcactggataaattagcctcaccgctgagattctccagtttcatcgaacgacttaagacttgatcattaaggtggttcagctgttcttcatactggtgatcaaccgcactcagctgttcggattgatgctccaagtccttaaccttagccgtcaacgccgcaattgttgctttggtaaccttggcctcaccttgtgttttctcctgttcagccgctagctgctcaatttcaagtgccaacaaggtttgatggattcggtgataatcagctgattgctgttggtaatccttggccaacgaggcttgttcccgcaacggttcaacctgatgtttcaactcgacaataatatcgttgatccgcgccagattgtcgtcgttgttagctaactcgcgctctgctttggttttttgctgcttatatttataaacgccagcggcttcttcaatgatgccccggcgttcttctggtttgctattaaaaatggcttcaacccggccttgcgaaataaatgaaaaactttcgcgtcccaagccggaatccataaacagatccacaatgtctttcagtcgcacatcctggttatttaataaaaactccgaagtgccgtcgcggtatagtcgccgcgtcactgaaacttctgccggttgatttttaagataaccatcactgttgtcaaaagtcattgtgactgctgcccgatttaaagcaggacgactatccgtacctgcaaagataacatcacccattcgttcgcctcgcaaactcttggcactctgttcacccagcgcccagcgaatcgcctcggtgatgttacttttcccgcttccatttggcccgacaattccggttaagccggaaacaaaatcaatttcggttttatctgcaaatgatttgaagccattaatgatcaaacgctttaattccatgatgactccattctaaatcttactttttaagacgggccaaagccgccttagctgcagcttgctccgctgcttttttgttcttgccaaaccccgtgcccaaaacgtggccttcaacttcaacatcaacgtgaaattgacgctcatgcgcgggtcctttttcgtctaacaggtgataaacaatcgcgacatcaccattttgctgcaaggtctcctgcaaggccgttttatgatcctgatcggccgaaaactcacccgcatcgattttaggaaaaataatccgcttggcaaacttaatattagcttctcgtccttgatcgaggtacaaggcaccattgaaagcttcaaacaaatcttcaagcagcgtcaaccgttgtcgggcaccggctttttcctcgcctttacctaatttaatataacgatcaaaatgagcttctttcgaaaaagcagaaaatgccgcggtttgcactgccgctgcccgaattcgggtcaaatcgccttccggtttatccggaaatttacggtacaaatagtctgaaaccgttaattcgagcacggcatcacctaaaaattcaagtcgttcgttatcttttagtcctaattctttatgttcattgacatacgaagaatgcgtgaatgcttcatccagtaagctgagatcatgaaactcaatcccatagcgttgacgcaattcgctcacaaactctgaggcaaccatgaagagccctcctttttatcgcactatctaattatactagagcgcaccaaaaaagacacctgcgattgcagatgccttaatggtttaacttttaaaccgaattactttgttgcacggctattacttgtaaccgtcattttactccagttcaggtacttcgctgaagcatagtcaacactcgcattcttcacacgtttattaacagggaagatttcctgacgataaagcgtagggatgacaaatgcttcatcgttagcatatttctgccatgccttcaaagccttagcacggtaggcaggatccattgctttttgactatcaatatcattcagcaacttggtgtttttagcagaaacgaaccgagtgtagttaaacggtgctttctgtgagaacaagtccattggtgaaggatcagaagagaggctccaagcagcagcataaacatcaatacccttggaatcattttgaaccttgtcatagaaggaattaaactcgattggacgaccggttgtcagcttgacgcgcagaccgatcttcttccactgctggatataatcctgtgccaatggttgcgccgttgaaccgtcagccatggttgcaaagtaaatcgttaacttcttgcctttaggatcggttcgatagccatctttgcccttcttataacctgctttatccagcaagctattagccttgtcaatgttcaaatcatagccatcgatatcagcgtgaacatctttaccaaaaacaggtgggatcaatgtcgttgcacgagaccgcgtaccgttatagaacttggccgcgacttgatcgttgttcaacgcatagcccattgcctgacgaagactcttgttggccatcttcgaatttggatcataaacgttttcgctcttcttatcatcccatttaccgagtttgaaaccaaggtaattataagcaaggctttgatgacccagattcgtgtaaccactaatgttcttccagtcactataactgtcggaaggcatgccataaacgatatcatacttgtggttctttaaagctgaggtgattgaagcagatgaaacattttcaaatgtaatctttgaaagactcggcttgcccttccaatagtattggttcggtgtgtattcaacgctttgtccagcgacaactttactgatcttataaggaccaaagaacaatggttgtttacgaaccttatcactggattccagtttgtcaaacgcaacatcatgtaagtaatgatatggcgcagcactttcaaggaagtacccgttcccagaagtgttaaatgacggcttcatctgcttaaagtgaatcaccatggtattaccattatcacccttaggcatcgttaaaccagaaatagtatccgctttgccgtcatgatactcggtcaacccctcaatattctgaagtgattcggtgtaccgctgactcttagtcgctttgttagccatgatttcataagcataaaccaaatcacgggcaacaactggctgaccatccgaccatttaacatttggtttgatagtcaccgtgatggtcttggcactgttgtcctgtttgattgttgcagcaccattattattaaatttaaatgtgctgttatacgcaaacaagctctcagctgccgggctcatgtagtcattatcatacgcatcagtgtatagttcttcgttaaagacccccttaaatggagagtcattgacgacagccacattgacattaccgcctttgattgcctttgcagtgttattataagaaactgggaacttcacactcttattagctgtacttgagctggagttcgagctcttattgccacaggctaccaaggtgattgataaagcggtagcgagcgtgatcattccgagcacagaacgctttttcatactttttcccccttccgcgtcgtcatcgcgatatgtagcgaagcaacgcttcatgtgagttaaatgatagcataattagaacaaaataaccaatgtttcgtcatattttttacattttttcttcaaaaaaaagagccactctgatttctctgagtagctcttcattattttcaggaaattgtcaatgtttcaaccacgccgttgccgcgaatcggctgcccgtcgcatcgcttgaccgacaaaattaattgataacgacaaagttaacagaaccaatactgctggaaaccaaacccaccagcgattaaaaatcaaatccgggtttgacgcgtatccaatcagtgtccctaaactaggagtttccatgggcaaaccaaagcccaagaaagacaacgccgtttcgatcccgatggaactggcaattgtcagcgtcaagtccgtaataatcaaagaactgatatttggcaagacaccggtaaacataattttaaggttcgatgtccctgacgtttttgacgccataacatattcacttcgagcttcagacaacaccagtgaccgcattaatcgcgttgtcgtcatccaataaaaggccgccatgatgagaataatggtgatgacgttgtattgcggaataatagtaaccaaaacaatgatgaccaataaagatggaatgatcatcataaagtcaacaaaccgcatgatgacagcatcaaccaggccgccaaagtacccggagattgttcccagcacaaccccgacaaactcaataatcaaagcaaccgaaatcccgatggtaatcgagttacgggcagcgaagaaaagatacttgaacatatcgcgtccgccttcatcggtaccgagaatatagccgcctgtccccggagccatgtaccgatccaaaatgttgacctcagtagcgccaccaacattaaagagcatcgagccaataaacgcagcaagtataatcgttacagcgagaaaaagcgaaaccacagcaactttatcttttcggaattcattcagaatcaccttgaagttagaaggtgattgttcaattttagtggtatctgtcgccacctcattcgcattattttgcataagctttccccaccttctattcaatccgaatccgcggatccacgatactcatgatgatatcagataacaaattaccaagtaacgtcaagaatccgaatagcaacactaacgatataacgaccggatagtcacggctggtcatagatgatacaaaaagctgtcccattcccggataactaaagaccgtttccaaaataaccgacccgccaagtaacatcgtgatttggttacccataaacgccgcaatcggcaataaggaattacgcaaaatatgtttattgaagataacgcggtctggaaccccttttgatcttgcggttcgaacaaaatcctgatgggtgttatcgataacgccggtccgcagatactgaatcgtactcgatgtcgtgataatcccagaaaccagcgcaggtaaaatcatatgatatatccgatcccagacatagcccaaagtaccgggattataagtggacgacacgctaccaccggtcgggaaccactgaaggaagaacccgaagaaaataaggcccaaaagatagaaaacaaacggcggaaccgccatcaagatgaaggaagcaatcgagatagcagagtcgcgtttgcttccttcataacgacctgcaatcacgcctgcagggattgcaatgacgtatagaataacggttgataacaaagccaaccaaaacgtgttcgccgcacgttcgccgatcaaaccagtcaccgaacgtttgtaaacaaaactttgacctaaatcaccatggaacatattaccgatccacttcacgtactgaatgtaccatggatcatttaatccatactgttgccgtaatgccgccatctgagcagcactttgtccttgcgaaaaattacctgccaatggatcgcccggcatcattttggataggacaaagactaacacactcagtaaaatcaactgcgggatcatgattaagatccggcgtagaattgttttccacattaatcatgcactcccttcatggttgaatctggcagcgcaacgtaatgtgtatcggaaatcttctggagatccaaaacgcggccttctttggaataatatttagattcttcttctttaaaaatgcgttccacttcccggcgatgttccttgttttgcgcgcgatcatcaggattaacatccggaatggctgacaaaagacgcttggtataaatatgttgcgggtgctgataaatgtcttcccgagtaccgatttcgacaaagcgaccacgatgcataatcgccatcttcttacacatatgcttaacaacgcctaagtcatgggaaatgaacaagtaagaaatattatattcttcctgaatccgcttcatgaagttgagaacttgagcttgaaccgacaaatctagcgctgataccggttcatcggcaataatcagcttaggattcgttgccatcgcccgagcaacaccgattcgttgccgctgtccaccagaaaactcatgagggtatttatacaatgcatcgcttggcataccgacaatatcaagtagttcctgaacccgatgccgttcctcatctttagtcagattctgaaaattacgaatcggttcggcgataatgtcctcaattcgtttgcgcggatttaaactagacaaggagtcctgaaaaatcatctgcacgtctttattatattgcagtcgttttcgcacgctgcgtttggtaatatcttcacctttgtagataatcgatccggaagtaaccggttcaagtccgacaatcgctttaccagtcgttgacttacccgagccagattcgccaattaagccatatgtttcgccttgctcaatatcgaaattgataccatcaacggctaacacatgatcagttacacgattaaagaaacccgaacggatcggatagtggatttttaaattttttacctcaatcattgccattattactcaccttttccagccgcttgtttgtcatccgggaaatagaagtccttgtagcaagtacactgaacaaaatgatccggtgcgacttcatgcatggtcggatgttcttcgtgtgccgattccggaatccatggaattcgtggagcaaagcggcatccttccatctgcatattcttcagtgacggcaccacgccttggatcacgtgcaattcgtcatcatcagaatccgcttgaggcatggagcgcaaaagactgcgcgtatacgggtgagtcgggtgcttgaaaacatccatcaccgagccgctttcgacaatctgcccggcatacatcacggcaactcgatcagccgtttctgccaccacacctaaatcatgggtaattaaaataatgcctgaatgcatttcccgctgaatatcttcaagcagatcaagaatttgagcctgaatcgtcacgtccaatgcggtggttggttcatcagcaatgataatcggcggcttgcaggcaatcgcaattgcaatgacaatccgctgacgcatcccgccggacagttcatgcggataggagcgtgctgtccgctccggattaggaatgccgacttgactcagcaattccaaaacccgttgttcgcgttgttccttgttcatcttggtgtggtagacaagcgtctcttcaatctgctcgccaatacgcatcaatgggttcaaagcagccaagggatcctggaaaatcatgccaatatctttaccacgaattcgatcaaaaagcgtttcgtttaagccaactaggtttaggttattgtacaaaatatcaccagtgacctttgtgttacgtggatcatgcaggccaatgatactggttgccaaggtactcttaccagaacccgattcacctacgatcgccaaaatctcatcttttcgtaacgtgatgctgacatcatcgacagcatcgtaaaaagcatctccaagtctgaatccggtgtgcaaatgttgcacatccaataataaatcttcaggtttatccaagcgaactcctcctttgcgccctaaacgcaagattaaaacaagatgagattttcgaaataattgtctctaagtataaagaaattatagtagttatgcaagcgaaaattgcgttcctgcgcgatttatccgtgaattctcccgaaaagccccttcatgttttgcttacaagaatatgcttgcttgacgaaaagaaaaaaggcttagaagtcattttaaaggctcattttgcagttttggaacgccttcaggcaaaataaaaaagccgccatgaatgacagctctttgtacattatttttgatgtgccttgatataatcgacggcatcttgaactgtcttgatattttctgcatcgtcatccggaatttctgaaccaaaggcatcctctagttccaaaacgaattccacaatgtcaatcgaatctgcatcaagatcttctttaaagttcaaactcgggctgatcttatcaggacttagttgaaagtgatcctgaatcaagccggcaatcttttgataaatttcgtcttcactcatactgctcctccattcatctgccaattcagtttacttgtttgctcaaagaatgtctacgctttctcagtagttttcgcttcggcaatttccgggtgggcatcaaagtaatcggcaactttagcaacggtgccgtttttaaccatcgttgctgtttgcaataacgtgtagtagacggtgtcggcatcagcagcgccatgggctttaattaagggtgctttgagccccagcaaaactgcgccgccatatgacgaaatatcaaatgtttgggccatggatttcagattgtttttcaggaacaaaccgcctaatttgccggagacgccgccgtcataaatcgcgccttttagcatatgcatgaccgtgcgcacggtaccttcgatcgcttttaaggtcgcattcccagtaaagccatcggtcaccaccacgtcagccgggccgttcaaaatgttactagattcaacattcccgacaaagttaatccccggagcggcggccaaaagatcatgcgcctcctgatgcaacttatcgcctttgtttgcttctgtaccgttattaagcaagccaacacgtggattagccacgccgcgcacgtctttggcatagtagctacccataatggcatattgcaatagatgatacggacggttttcggcattggccccaacatcgagcatgacaaaccctttcccatcgactgtcggcagcgttggtagcaagcccggacgttcaatggcgcggattcgaccgatgataaacagtccggctgcaagcagcgccccggtggaaccgagtgaaaccatcgccgctgcttcgccttgcttgactgcctgagctgccagtaccatcgaggcttgcttcttccggcgaatggcacgtaccggttcatcatcactattgattttttcggcagtgtgaataatcgttagccgatcttgattgtgaatcagcggcttaatcttagcttcatcaccgtaaagcaggaattctaaattggcatcatggtcgcgggctttttcaacgccggcaatcacaacttcgggggcatgatcgccgcccattgcatctactgcaattttcatggagtttatcggtcctttcgagtttaatccaaactgccttgcatcaagcgactcgcggctaagtatgccgctagcggttgatgctccggtgccagcaagtgaggatcagttttaaaaattttagcaacaatctgttgagccgcttccagagtcggaaagtccccgaccggatcggccactttaaattccggcaaacctgattgcttatcaccaaaaatatcaccggaaccgcgcatttccaagtctttttgagctaacaaaaagccgtcattggtcttggtcatgatttgcattcgtgcaattccttgttcatttttcggatcggcaatcaacaaacattgggcagccttactgccacgccccactcgacccctgagctgatgcagttgggataagccaaaacgatcagcgtcaaaaatcgccatcaccgttgcattcggcacatccacgcccacttcgacaacggttgtggaaactaacactgcaatgtcgccatggctaaaggcgcgcataatttgatctttctcatccggcttcattttgccgtgaagcaaggcaacttgccccacatcccccacggccttttgcatatccgcaaagagctgctcggcgttttgcaaatcaactttttcagattcggcaattagcggcgtgatggcaaaaacctgactgccggcttgcacctgactgcgaatcagtcgataaacctgtcctacctgattcttacgcagccaagtggtcgtaatcggcttccgtccggcgggtagttcgtcaatcgttgaaacgtccatttcaccataagccgtgattgctaacgttcgcggaatgggcgtcgctgtcattgacaagagatccggtttttgccctttctcctgcagaattttccgttggttaaccccaaaacggtgctgttcatcaatgacaactaagccaagcgctttaaaatcaacgcctttttgaatcaaagcatgcgtgccaatgattaaattcaaggtgccatcgcgcaattctgccaacatttcccgccgtttttttgccgtggtcgatcctgttagcaatcccaacttgacaggaaaatcagcaaataatgcctccagtttggcaaaatgctgttctgcaagcacttcagtgggtaccatcagcgctgcttgatagcccgcagtcaccgcagcgtataatacgatagcggcaacaatggttttcccgctaccgacatctccttgtaataggcgattcatgtgattgggtcggcgcatatcggcacagatttcgttaaccacacgcttttgggcattcgtcagcgaaaatggcaaggttgcaatcaacgcccgcaacgcatgattatcatacggaattgccaggccgttattggcattatcgttcagctgtttcagcgcctgaatctgtagctgaaacaggaagaactcccggaaaacaccgctgcgccgggctgcttttgcttcctgcggcgtatccggaaaatgcatgccatggaccagttgttcgtcagacatcagacgatagtgcgcgcggatactagccggaatcaagtcatggatattttgatgatcccgtgcccacgctgccttgattagctccagcaaggtccccatacggacatttttattcaccgtataaatcgccgccattgacggttgattctgagactgggttgccagaatcttcatcccggtaagactgcgccgctgagcatcccacttgccaaaaaccgcagcttcatcgcccatttggaaccgatcttttaaccatggctgattatagaaggtcaccaaaatcacgctgcgttcgacttgcaatttaacgttcacccggctgcgatgcggaccaaagcggctgataaccggatcagccaccacgacacctttaatcgtcaatttttcctgatcagctgcctcagcaagatctttgactttaagatcgtcgtagcgaaacggaaaataaaaaaggacgtcgcccacggtatgaataccgagactggccaatccttcttctcgttttggccctacaccaggtaaaacccgaaccggatccgtgagcgccatcttctacctcctttcgcgttgatgccttaacctcatcacggcatggatcttctgtcagtctcgtaaaaaagtgccccgcatgcgggacaccttggcaagtgaggcaaacgctttattcaaccgaaacaaaataaggataaaccggttgatccccttgatgaatttcaaattcaaggtctgggtgctgatcgcccaccgcagctgcaattgctttggcttcgctttggctggcatctgccccaacaataatggtgacgatttcactgtcagcgttaatcatcttattcaccatcgcaatcgccgcaacttcacgattctgatcggtcacactgatcgttccgtcaatgatacccatccagtcgtggttcttaatagcaagtccattgatggtcgtatcccgaatagcctgggtgatggaaccactgacaacatttggcaattgcgcggtcatttcactttgattcgtcgccaaatcggcatccggattatagccaagcattgcggtcataccttggttaatcgtcttacttttgacaacggccacttcaacatctgtggcggccttggctgcggcttcagcggccatgaaaatattaccgttattcggtagtacgataacatgcttggcatgggctgacttgaccgcatccaaaatatcattggtgcttggattcatggtctggccaccgttgagcacatacgtgacgcctaaactcttgaatagctcaccaagcccctgtccggctgcaatggcaaccacgcccatttcagctaacggttgcgtatcggccttagcatccaaagccccttcacgttcgatgatactttcttgttgcaaacgcatgttatcgactttgatctttaacagatcgccaaactgttgcccgtatcgaaaaaccgttcctggatgttcggtatggacatgcactttaacgacttcttcatcggccacgaccagcgttgaatcacccaaagtattcaggtaattacggaatggctcgtaatcaaagtgtttaaactgatcgccatgacctagctcgaccatcatttcggtacagtagccgtacacgatatcagccggatcaagttgagtctgagcgctttgatgatgcacggcgttgatcatttccgtcatttcttcatcggtcacatcatgtacatctgaactgatttcaccggacaagccttcacggaaaccttcataaatgaaaaccaatccttgaccgcctgaatcaaccaccccgacttcttttaataccgcaagaagatcgggagttttggctaaagcacgtttggcgcctttaaccaccgcggtcatcacgactaaagcatcgtccgagccgttagccgccttcagccccgctttggctgcttcacgcgcaaccgtcaagatcgtgccttcaaccggcttcatgaccgctttgtaggcagtctccaccccgtggacaaaagcatcggccaaatcctgtgcgctcagattcttcttaccttcaacgcttttggcgaatcctcggaaaagctgcgaactgatcacgcccgaattaccacgagcacccatcagcaagcctttcccgaggcgtttagccagcgcaccgacagcgtcttcatttgactccaatactgctttggcaccggtctgaaaagtcagattcatgttagttccggtatcaccatccggaaccggaaaaacgtttagtgaattcacaaattcagcatttttattaatacgatgtgcggctacccggatcatgtcctggaatttagtcgccgtaatttcggttactgccacgaaacatcctcctcgaagaacttcattatctgatcaccgtcgcaaaacggtgcgttaacgtcagtcgcctaataccttgacgccttggacgatgacggtcacttcatcggttgtgacccccaacatcgtttcgaggttgtattttactttgtcttggacatttcggcaaacttcggatattttggtgccataactgacaatgatattcacttcgattttcacgccattgtcggtttgacgtaccacaacaccgcgcgcataattctcgcgcttcaaaatatcattgagattatcccggatctggttacgactggccatcccgacaatgccatagattgacgttgccgcaccgccaaccactgttgcaatgacactattggaaatgtcgataatcccatatttggttttgatcttgaccgccatgctgtatcctcctagccattaacgatgctattttcaccgcatacaattctaacagatagtttagcatagggaagaagtcattaaaagcgcgcacgattcgaaaccacggtcgactaagctaatcatgctgcctgtcattgcttccctgatgacctgacacaaaaagatcctgacaatgaaggatgcatcacattcattgtcaggatctttttaatcgttatgggatcaaacccgggtcactttacctgatttaagggcacgtgcagaaacccatacccgctttggtttaccatcaacaaggatccgaaccttgtgcaggttggctttccattggcgccggcttgaattcaaagcgtgagaacgcttgttgccaaacgtggtatgacgaccagtaataacatctttagccacaatatgacctcctttttttcaaggtcaccctcgaatttttcactcaactaacttatcataggcccgcggtgaatgcaagaagttttgcaaagtaaaaatacttgacaggctttaaacaacagctcaatctgctcttttttccgaccttaccgcgttaattatcgactttttgtccgcggcgatcgcggctatagacaatcgcgacgacaccctttgtccagctcaccgtaaatggtttagtcccgacaaattcattggaagcccacgaaaatggcgaagcattgtcccacgcctttaacgggtacttggcgccagtaatcgtcaggtcggtgataggggttaaattgacaactgccacatagcgataatctggcagcggttgaatttcatggacacccggggcatagtaatcgacccgattctgcacatccaaaaggtgaatgcgttcaatcgcgggtaggaatcgcgactggagcggcaaaaacaaattggacaagaaatgatccagtcgcccaccggttgcccccagtatgatcacgttaccagtcgaaaaacattgtaaagcagctttgacggcaagctctgtatcggtatcatctttttctgaagggacttgccgaattttcttgacgtgttcacggacggcgcgtaactcgctcaaggttaatgagtcaaaatcgccaactgccagatccggctgaatgcccgcttcaacaagatgcaaggttccccgatcgacgccaatccatacccccggcaactcttgccagtcagtcggtaaatcatcatgcgggccgccagccatgatattgatagttgtcattgaaccgcctcacgtaaagatgagatggccgcaccgacatcactggcaccaaagacgtatgaaccggccacaaaaatatcggtccccgcatctgctgcagctttcacggttttggcattaatgccgccgtctacttcaatatcaaaatgcaacccgcgatcctgacgtaattgatgcaatcgggcaactttatccaccatggcagtcaaaaacttctggccgccaaatcccggattaacggtcatgaccaatacctgatcaacaagcggtaaaacttcttccaaactgcttaaaggcgtgcccggattcaccacgacccccgcacgcaccccggtcgctgcgatatgctgaagaacgccatataagtgatcagtcgcttcctcatgcaccaaaatcgtatcggctccggcttcggcaaaggcaggcgcccacgctgctggatcactgaccattagatgaacctctaacggtaagttggtaaccgggcgtaatgcctgcacgactaatggaccaaatgtcagattagcgacaaaatgaccgtccataacatcaacatgcagcaagtcggcacctgcctgctccactttttcaacatcacgggctaaatgagcaaagtcggcgcttagaatcgacggggcaattttcatgagaatccctccattttaaaagatgaactactttttcttatacactgggcgcttgccacttaattcttctcgaaactgtaaataattttcatagcgactggccatgatctttccggcatccaatgcggctttgacggcacattgcggctcgctgacatgctgacagccccggaatttacagcgcggggccaaggcaacaaattcaggaaaacgatcccgcaagtcatcaagcgtcacatccaacaaaccgagtgaagaaaatcccggcgtatcagcaactagcccgccatgaatcggatatagatcggttgtgcgcgtggtatgcttaccgcgatttaacgcccgactaatggttccggtagccaaatccaaccccggtaccaaatgattaatcaaggtcgacttcccggcaccggtttgacccgtaaaaatagtcagcttgtcagcaaaactagcctgaacttgatttaacgtggcaggatcaaaggctgcttcgggcatgaaaaccgcatacccgatggcctgataaccggctaaagcttcttcaatttgcttcaacagccgtccaggcgccaagtcggttttggtgaggtaaatttcggcatgaatcgcatgcccttcaagataaaccaaaaaccgatcgagcagattcaacgaaaaatccggttcaacggctgagacaatcaacaaagcctgatccacattggctactggtgggcgcaccaacgcattgtgccgtggcagtatccgcaacaaatagccttcatcatcaccttgacccggctgaaatacggcaaaatcgccaactagtggcgtgatcttgtcattccgcaggcttccgcgaccacgagtgcgataaatcgcaccatcaactgcaagatcataatacccgctgatttgtttgataattcttccggttaattcttcactcattgtgtaatattgtactcctgtgcgacaacggtgccatctcgtaccacccgataactacccggatacgtcttgttgacttgcaaggtaatggtgacctgattatccgcggtaatattaaacgtcttgttaaccgaattaatgttatgtgtcttatcgccgatgaacacctgaaccccgtttggcgtcggtccactgctgctagcactgccactactgcttccgctgtcgctggatgtgcttgaagatgccggcgcctgataagggattgaaatggttttggtaacggttttgagttcatcgggatccggaccttgagaaatcgtcacattgaccgtatcgcctgcgtgaacctgcgtgccagcagccggattctggctaattaccataccggtatcaacggtgtcggaatgactctgagcaatcacaatcttaagtccgacctcatttgcgtagtcacgcagactcttttccgtataaccggtaagatcccgcagtgcaaaggccgtattgactttcttaatcggctctgcaacatcaaacgtaatcgtggttttacttgcaatgacttttttgccgggtttaatgctttgtgccgtgatttttccggctgcgaccgaatttgttcggaccactttttccttgacggtaacaccgcgtttttgcaaatcggattttgcatccgtataatcctgaccgacataattatccaaggtaatgcgcggctgtccgcgactcagtatcagatcaaccgccgagccttctttgacactgacctgccgcttaggactagagtctataaccagatccctatcgactttggttgagtaagtatagcgatactttccgaccttcaatcgcgaactggttagtgccgttttagcttgcgtcttggtcatcccgcgcaaatcagggaccgtcacatcggctttttgattggccgtcaccaatccaattcctaccagtattaacatcacgatcaaggcgctcaggccgatcatcaaccatcgccgtcgtttcttcttagcctggccatctggtgaatggtgttcagcaggttggtctgcgtgatcgtcatcatcatgcggtggcttggggccgttgggaatgaccggtacaatgcgcgtctcatccaaatcatcttttggaatcacatacttggcttcgtgagcccgggcaggactgagcgccgtgctgagatcgcttgccatggcgtcggcacttgtataccgattagccggattcttcgccgtggctttaaaaacaacattctctagtgcctgaggaatatggggatcaaaggcgcgcacggatggaatttcttcttgaaaatgtttcaacgcaatcgaaaccgccgagtcgccttcaaacggcaccgaaccggttaacatttcaaataaaataataccaagtgcataaatatcgctttgccgtgtgggcatactgccgcgtgcctgctccggtgataagtaatggacagagcctaacagagagttggtcatcgtcattgaattttccgataacgctaccgcaatgccaaaatcggtaatcttggcgttgccatccggatcaatcaaaatattttgcggttttaaatcacgatggataatattgtggtcatgcgcggtctgaacggctgacaagatctgttccatcatatcgacaacgcgttgataaggaatcgggaagtgttcaacgatatagtgtttcaaatcagagcctttgacatactccatcaccaaaaactgttggccgtgactttcacccacatcataaatcgacacaatattgggatggaccaattcacttgtcgccatggcttcacgctgaaatcggcgcaccgtatccgggtcattttgaagatcgagccgtaaaactttgaccgcaacatcacggtcaaggatcagatcgcgtgccaaataaacgttggccataccgccttcgcctaacgttttgatgagcttatagcgttcatttaaaatcgtccccggctcgatcatgacggttccctccgatcctgatgaatgatcaaagcagtgatattgtccggacccccggcagcattagcccgtagaattagctcctgggccttgctgccaattggcatatcctgacgtaaaacagccgcaatggcttcattatcgatcatattcgttaacccatccgagcacagcagcaaataatcatcaaattccatatcataaattgtcacatctgcgtcaacatcgctgctaactcccagcgaacgggtgatcacgttgcgttggggaaaacgtttggcttcttcaggggttaattcaccatgtttgaccaattcgttaaccaaactatgatcctcggtaatctgaaccagatgcccgttgcgatataaatacccgcgcgaatccccgatattggcaacgacaaaacgggtaccgctgatgatcactgctacaaccgttgtacccataccagataagtcagtatattgtttagccttttgcagaatcatgtcattttcctgctgcaactcaaaaataagccagcggacgatggactcaatctcggcagtgtcggttttctcaaaagcatagccgagatgggaaacggccatttcactcgccacgtccccgccgcgatggcctcccattccatcagccactaaagcaagggtggcctcagactgattcttaaagatgccaacataatcctggttatttggccggcgccgaccaatatcggtgcgataagcaaactccatacatacccctcatttacggcgaatcagactggcgatgaaaaagccatcggtatcataatcgtcgggaaataattgcaaagctggtgcgccatgcgttttggcaagtggttttagcgtcaaaacaggtacctgttcgaactcgggatgcgttgctaagaagtgggccaccacatcctggttttcctcttttaccattgtacatgtactatacgtcaagcggccaccgatttttaaagtaggtgcgacactatcgagaatcgccaactgaattttttgcaggtgttgcaagtcttcaggctgttttgtgtacttgatctcgggtttacgccgaatgagccctaacccggaacaaggtgcatctactaagattttatcgaaagactcagcagcaaagttagccgcaacctgacgcgcatccatcacctgtgccgccacgcgatcatcaaggtctaaccgcttagcattttgttgaatcaagcggactttattggcgtgcagatccaaggcagtgacccgcccgccttggtcaggatccagatactgggcaatgtgcgtggttttgccgccaggagccgcacacgcatcaagaacctgatcgcccggttgtacatccagactcggtgcaacaagcatcgagctttcatcctgcatggtatacagaccgtcagcaaattcccgggtgccggctaaatgcccccctggcgcaactagtccaactggcgtgagcggactttcttttaacgctggaaattgcggctgcaacgccttcaataaagctgccgccgttgttttcgttgtgttgacgcgaatcgaagcatgggccggctggttaatggctgctagaatcttggcggtctttgtctcgcctagctgtgcttgcagcttttttaccagccaaaccggcgtactgctggtaatcgccaaacgttgaatcggatcagcaattgtcatcggatcagggtacccactgcgctgtgcctgccttaaaacaccggtcacaaatttagccaccccttgatggcctaattttttagcgatttccgtactgtcaaagaaaaccgctcgtgccggcactttatctaaatactgcagctgatacaccgccgtctgcaacagacaacgcacccaagtatccaattgtcggtttttaacaaacggcgccaaaagataatctagcgttaattggtgctgaatcacgccatagacaacgtttgtcagtaaaccggcgtcacgcgaatccagctgatatttggtgatcacgtgatcgagcgtcaggttggaatagccgcctttacccatgacgcgggttaaggtttgaacggctaacagtcgcggattattcggggtcatcggtgatcacctgctgtcccacggttaaatcgcggccagggccgtttaaatagtcggcaatatgctgtttgcttttcccggctggctggagctcatcaatttgaaaggtgctctgttcgcccgccgcgatgacgagttgatgcttgctgcgtgcgaccacgctgccagcaggcaagtttgtagtcgcggttaatggtgtgatggcccaaagcttggttcgttggccgttcatataaacatacccgccgacttctggccgcaagccgcggacccattgatccaatgcttgcgccgacaagtgaatatcaaggtgctcctgctctttggtgatggtcggggcaaacgtgactttctcgggatcctgtggcgtacgggtggcggtttggtcaataatcttcggcaaggttgccaataacaaatcacgacccaataaagataatttcgcaaacacagtgccagtatcgtcttggcgggttaacggcaacttcgcctgcgcaaacatatcgccagcatccatcttcttaaccatttcgataatggtgacgccggtttcagcatccccgttgataatgctgtactgaatcggtgcgccaccgcgatacttcggtagcaacgaaccatggacattcacagcagcaattttggctgcttgtaaaaatttggtcggcaaaaattgcccgtacgctgctgtcacaataagatccggcgctaaggcaatcgcctgcgccagctcaggactgccgctaagcttttctggctgtaaaaccggaatgttatgagcgacggctgcttgcttgaccgggcttgcggccagtttctgcttacggccgactttacgatccggctgcgtcatcactgccaccacgtcataatgctgggcaatgagtccttcaaggatcgggacggcaaaatcaggtgttcctagaaaaattactgaagtcatgttttcctccaaacgatcgattcgatatgatgcgtgatacccttcgttgacaacaacttcaaacaaatgatagcggttcgggatcaatggttacctgaaatccttgccggctgctttgttgcgtctcttcaagaatatgttgcaaggttttggctaaggccggttcatgtttatattttaaaacgatctgataaatatagcgattcttcaagcgtgcaatcggtccgggcgttggtccaagcatgattacctgatctgacagctgtgcgcgcaattccttagccaaggaaaaaattgccttcgctgcctgcgtctcatcaggatgactaaccccaatcttagttgaaaagaaatatggtgggtagttgccttggtggcgcactgccatctcctggcgaaagaagccttcgtaatcctgacgtttggcatactgaatggcgtaatgatccggattaaacgtctgcacaaacacttcgccgggtttatcggcccgccctgctcggccacttacctgagttagcaattggaacgtcttttcactggctcgaaagtccggtaatcccagcgatgtatcagcattaatgacgccaaccaaggtgacatcaggaaagtccaaccctttagcaatcatctgggtgccgagtaaaatatcggcttgatgagcgccaaatgcattcaaaatccgggcatgtcccccttttcgccgcgtggtatcaacgtccatacgtaaaatgcgcgcgtttgggagtaacgtctgcaattgagcttcaactttttgagtgccggtgccataatagcgaatcttgtccgatccacactgcgggcagcggcgcggaattgcttcttcatgaccgcaatagtgacattttagcgtgtgcgtatccatgtgcaacgttagactgatgtcacagttaggacactttgcaacgtaaccgcaatcgcgacacatcacaaaactggagtatccgcgccgatttaacagcaagacgctttgttcatgccgctccagacgcaccttcaacgcatctaacaacggcgccgaaaagtcttcctgagccccctgcgcaaacgcttcacgcatatcgacaatgtgcaccggtggcaatggctgatcgttaatccgctgcggcaaacgtaaaagcgtgtatacgcctttttccgcccgcgcacgggattccaacgatggcgtggccgatcctaatacaaccggtgcatgatgaatctgtgcccgcttgagtaagacgtcgcgagcatggtaacgcggtaccgaatcctgcttatagctggtttcgtgttcctcgtccatgatgaacaccccaatatgcctgagcggtgcaaacgcggctgaacgcgcaccgacgacgacttgtgcctcgccacgggcaatgcgccgccattcatcatatttttccccatcagacaggccggaatgcatgacggcaacatgcatcccgaagcgtcccttaacccgatcaaccatctggggcgtcaaagcaatttcgggcaccagcatgagcgcggtttgccccgccgccagcacctgcgcaatcacctgtagatagacttcggttttacccgatcccgtcaccccttcaagtaagaaagttttcggctcttttgctttcacggcttgattgatcgtgtccacaatctttttttgatcgaccgttaatggtaggggttgcgttaacggttgatgccgaagttgcggataaggatcgcggtacgtttcatgggcttctaattttaaccagcctttcgccgcggcctgattaatcgttgctttcgttaacttagtgcgatgttccacatccgtcagcaatggtcgttcatgtttggccgcccaggttccgatcaggtcaagcaattgcaattgtttcacggcatttttgcgtgtttgttgtttttctgcggcaacttgctcagctgacaactgaggaatgaggtagaaaacctgtttaactcgggcgcgatctttcttaacgtaagaaatggccactttttcagcctgtgccagtttcatcaaagcaacctgatcctcatcagaaagcgtgttgaaggcgacgctatccgcctgaccaaaatagcgggcttgctcctcagcagacaatgcaatcggttcggcaatcttaaccgcatcgatttttagcatggttggtaacatggtttgcatgcaggcaatccaaaaagaataagtggtttctgccagccatttcgatagcgccagcatttcctgattcaagaccggcgcgggatccaaaacatccagcagcggcttgagttcaccggcatactcactttgatcggaaagagcgacaaccatcccgctgactttccgcgctccttttccaaactgaacccaaacacgcatcccgggttgaagcgcgccatcgagtcttggtggcacaagataatcaaatggccggtctgtttgcatggtcggaacatccacaatcactttggcaatggttgccaagcgctcaccccttttgtttcggtaacatcgttgttaattgctcaattaaagccatggcgactttttgcttcgtcatttccggcagcgtcaccggtggctgatcaggccgcaaaaaggtgaccgtatccgtatcggcattaaacccatgggtcgcatcgactggattggcaacgatcatgtcggccttttttttcgtcagtttggtttgggcattggctaacaaatcattggtttctgcggcaaaaccgatgactacctgatgggttttcttttgccccaatgtcgccagaatatccggattctggaccaaggtcaacgtcaagccgctgttagcatcgactttttttattttgtggtcgctaatcgtcggcgcgcgataatctgcaaccgccgccgccataataactgcatcggcatccggaaaatccgccaatattgcatcagccatcgactgggcgctggtcaccggcttcacggtcaccccagggacaacaggcagctccctagtggtcactaaagtcaccgctgcaccagcaccagccgcggcgttggcaatggcggtgcccattttacctgatgagtcattcgttaaatagcgcaccggatctagtcgttcttttgtcccaccggccgagacaatgatacgccggccttttaaccgcggttccgcaagattttcaagaaacagcgcgatctgatccggttcaggcatccgtccgactccggtataaccttcagccaattgtccggtagcaggtggcagcagacgatagccttgtctgctaatcagccgcgcaatattacgctgcgtttgtggattttgccacatttgatcgttcatagccgggaccattaatttaggagcagtcattgctagcagcgtcgtggtgacaacgttgtcagctaaaccagctgccagctttgccaaggtattggcggttgccggcacaacgacccccaaatccgcccagtgtgctaaagcaacatgcgccacgtgttccggatggtcaaactcatgtccgtccgtcaacacagcatgtttactaacaatggccaacgtttcaggggtcacgaacttctgcgcactggccgtcatcgcaactcggacgtcatgcccggctttgactaacgcgcgcaccaacagtggtattttatatgccgcaatcccgccagtaacaaacaaggcaatatgttgctttttcatgaggcaccccttttacatttcgtagtagctttattatagcaaacgtgagccaagtttccggtcatggcgattaaaccaacccggcaaacgcatatccattaatgtttccaaaaatattgccataaaaaaagagcaaccggttgttctgcttaccgttgccccttacttcaatggtttgtcttttaatccttaatctttgtgatcgagtttttcggcatcccgttcaagcatctttgattttggatcaataatcacgtcgccagcagcaatttcttcaagcgctttgccgacactcttatctgatttatagtcggacaacattttcaaatcgcccgcttcaagttcgtgtgcacgcttggctgctaaaacagcaagtgaataacgtgagggcaccttttccaataacttgtcaattgaaggataaataatcatgtgatgagactccttttttcataatcgccaatttgccaagtcgcaaattggcgctccattatctagctaaatcggcactcgccaacatacctttgtagcggtcgatgacacgcggaacacgtaaatgttcactttcaatgatgcgctcaatccgcttgacggccaaatccactttgtcgttaaccacggcataatcataattttccatcatggtaatttcggaagccgccttgcgaatgcgcttatcgatggtctcgtcgtcatccgtaccgcgacctttcaatcgatgacgtaattcacttaaatctggtggggtcaggaagatgaacaccccattgggacacttcttgcgcacctgcattgcaccattgacttcgatctcaagtaacacatcacgcccggactcaagcgtttcattaacgtatttcagtggcgtaccgtagtagttgtcgacatacttcgcatactcaagcataccacctgtcgcgatttcgtgctcaaactgtgctttggttctgaagtaataatcaacgccatcaacctcgccaggacgcatttggcgcgtcgtcattgaaatagaatattgaaaatcccggtagttgccttcaagcatggcttgtcggaccgttcctttgcctacgccgctgggaccagacaaaacaatcagcattccccgttcgtgcatgtgtgaacctctttcgttaagtattactaaacattttgcactttttcaccgccgatttcaactgcttcaagaccgcggtaatgaaaacgtcatatggcgtaaggtcatctcggcatcttttttccccaaggccatcatttcggtaatcgctgcgggacgaaagttgaagagacgaggcagtggccgactaggtttcagataaacatcgccgtgatcagacccgatccggccaatccccgcgccactgatggccacaacaaaatcagcgccaatatctcttgcaatgtcaacgggcagatcattaaccacgccaccatcaacaaaactggtgccatgccggtcaatcggtgtaaaaatccccggcattgcgctggaggctagcaaccactctctggcatcagcaaccgaaagttcatctatgcgcgtcacatgggcacgtaagtcgggtaagcgcgtggtaacggctaaaaccgcccgttgatcacgttttggcaaccgcaacatctgctcaagtaatgggacaaagttacgtctggcaaagatcggtccccgcgtctttaagctggtcaaagactgccaccaatgcgccagttgttgcggcgccatgtgagccgtagcagcagcgttaatggcaccgattgaagaaccgatgacaaacgcaggcgccagtcgcggacccagcacgctccagacaccggcttgataagcaccatgcgccgccccgccaccaaaaacaactgccaataccaactttgccacctccaattctgtcacgagcttgccgttgttacaggtcgaataaatttcaaaaagtagttgcaagtttgaacacatgttcgtataatgaagttacaaacaaacgttcggaggcgcgatcatggaaaataaatcgtcagcactgcaaaatgtgacccatcaccttgtagcttcataccgggaattattcgatctggcagcacccacgatgcaaatgcccgcccatcaagtggatcttttcattgatcaggcgatgcaacgacattaccaaattgcactgtattttaaccatgaaaccgcgccatttgtgggccacattgtccgaccacttggtgaaaaacgcttcctggttaaaggataccacagcaatattttccgcatcatgactagcaccagtgtcaattacattaaacgattcaaatagctttttctgaatacggctcctgtgaccaagcaaaaagcgattcaagtaagaccgatgtctccttgaatcgctttttgttatgccggaaaaaatctacgaacattgaacttttagcgcatccaataccgtcaccagttcacctgactacgatgacgctttgccatgtttaaactcatcggccattcttaatagttcttcggcatgttcaatcgtcagcttagtgattttttcgccagccagcatccgcgcaatttcctctactcgcgctttatgggttagtttattgacttgggtcgttgtccgaccgtcatgaaccgccttgctgataacatactcatgatcggccatggcagctacttgcggcaggtgcgtaatacacaacacctgcgaccttttggcaattaagctaattttattggcaatcgcgtgcgcaacccgtccggaaacgccggtatcaacctcatcgaaaatgatcgccgtgaccccttccgagcgcgcaaaaatggttttcatcgcaagcatcagccgcgataattccccacctgacgcaattttggctaacggcttggcttcttcacccggattagtctgaatataaaagaccgcttcgtttaacccgtctgcccgaaaatctttggccttagtaaaatgaaccgaaaaaaccgttttatccatgtacagtgacgccagctgctcgtggatcgctttggtcagttgtttggcagcagcgtgccggcgttttgaaagtgccgcaccgagtttctgaagctgggcttgagattcttttaggttgctgtctagatcttcaaccgatgtttcggcttgttccatctgattcaattccgccgctgcccgtttgccataagcgatcacttcatcaagggtttcgccgtatttgcgtttgagctgattaaataaatcgagccgtttttcgacttcatccagccggccttcgtcaaattcctgatcatcgagttctttcgataaatcattttgaacatcctgcaaactgtaatacgcactctgcaagttgtcggcaattgccgcaaagtcaggatccaaatcggcaatgctttgcatactcgacattgcttgaccaatttgatcaagtgcattgacttcctcatcactcaacagggcatagctttcttgcaatgcagcattgattctttgaaagtttgccaaccgatcgcgttcggtgcttaaatcggtatcttcatgcggttgcagatcggcgctttgaatttcgctcacctggaatttcaacatatccagtcgttgcgcccattcctgttcatttgcctgtttttgcttcactgcttgtaaggtacgctgataattttgataaacttctgcatattggtggcgaattttcagcagatcatcaccggcaaaggcatccaataaacctagatgcgtttccgaatgcatcagctgctgatgttcattctggccgtgaatatccaccaacgtttcgccaatcgctttcaaggtggcggtgttgaccagatgaccgttaacgcgacaaacgttccggccgctgcggaataattcgcgctgtaacaagacggtgtcgttttggtccggatccatcaccccgaaagcctggagtttggcttccgtcaatggatttgcctgcgcgtcaaacaaaccttccaagcttgccttggatgccccggttcggatgaaatcaaccgatccgcgcccaccagccaacaaacccaccgcatcaataataattgacttgccggccccggtctcaccagtgagcgccgtcatccctgactgaaagctcaacgccaggttatcaatgatggcaaaatcatgaattgctaactcctgtaacatcttttcaccccaccatggcctcaagttccgccaatacatcggttgcatactgtgccgagcgacaaataatgagaatggatgcatccccgctaatcgtcgcaaaaattcgccggtcgtccaattgttcgatcaacgtctcaaccgcggctgccgtccctggcaaaagcgccaaatggacaaaattatccattgcttcgccccacttcatcgcggtaaccaatgtccgccgcagtttatccgtagcgggcagctgcttttccgcgggcatactgtagcgatagtgtccctcacctgccggaatcttgaccagttgcatttccttaatatcccgggaaatcgttgcctgagtgaccggaattttcatctcggtcaaacgggccaccaaatcttcctgccgttctatcggctcactttgaattaaccgttgaattgtcgcttgtcgttcgcgctttcgcatgtgctcacctctgtcatgaatgcatttttaacgtggaaaaatgctttacccatagcatagcgcagacgcaccaggcttaccaaatttttgcataaatattcaattaagggcgttttaatgcagcatacgcatcactaagggttcgctcgatatcaacagttggtgcgatttctccaggggtttggtcagcattttgcaaatgaattaaaaattcaatattgccttcgccgcctttgatcgggctatacgccaaacctaaaacgttatagccggtggcgctggcaaagttaacgatcatcttcaacacatcccgatgaacctggggatcgcggacaatgccatgcttaccaacatgcgcaggcccggcttcaaattgcggcttaatgagtgccaccgcgtgaccgtgcggcattaagatggcttttagcggcggcaaaatgagtttcaacgaaataaaactaacatccgtcatggcaaattccacggggccatcggtaaaatcttcaggcttgctataacgaaaattcacccgttccatcactttcacgcgcggatcctcacgaagtttccaagccagttgattatagccgacatccaaggcatagctcattttggcaccattttgtaaggccacatcggtgaaaccgccagttgatgcgccaatgtcaagcacggttttacccgtcaaatcaatcgcaaatactttcagtgctttagccaatttaagcccaccacgacttacatacggcatttttttgcctttcacatgcaaaatggcatcgccggggattttgacccccggcttatccaaacgttgattgttctgatcatagacttcgccagccatcaccgaacgcttggcctgttcgcgtgactcaaataagccttgctccacaagcagtacatcgacccgttctttttttacctttgtcatgcttgtaacaccgccaaaatcgattttaagtcggctgcatcaacggtcaggctgtttaacgcagcagtggctagctgaaactgggtcgccaatgcttgtttggcaccggctaatcccagcagttcgggaaatgtatttttgtgttcggccacatccttatcggcagtcttacctaattccgcggtggttttagtcacatcattgatatcatctttgatttgaaaacccagaccaaaagcagccgcaaaatcggctaaggcagcttgatcggcttcgggaatcgcgacaaacaaactacccattgccacaccggcctggatcagcgcgccggttttagcctgatgcatctgtttgagagttgctaggtcatattgcgtttgctcgccatccatatcaagtacctggcctgcaaccattcctgaactgccagccgcttctgccagaatttgaacgagttcggcaccttttcccggatagtgctggcttaagatagcgaatgcgtcggttaacaatgcatccccagccaaaatcgcgagcgcctcgccaaactgtttgtgattcgtcggctgaccgcggcggagatcatcattatccatagcaggcaaatcgtcatgaatcaaagaataggtatgtacaaattcaagtgcagctgcagccggtaatgcctcggcaaccacaccatcgtacatagcaacaacgctcaataacagcaacggccgcaaccgcttgccgcctgcatcaaccgaataagccatcgccgcacgcaaatggggattgaccacagttgccaattgttcgtctaaagtatgattaattgctgtttgccagtcggttagcgttggactcattgttggccttctttgggctgaaatggttgggtggtaccatcatcactcaccatttccgtcaccgtcttttctgctgatttcagcgttttttcgagttcctgactcaatttgaccccgactttaaattgatctagggctttttcaagggggacatcgccttgttctaattgattcacaataccttcaagttgtgcgagtttttcttcaaacgttggttcagccatgttttttctcctttgtcgtcacacgggcgccaatttgcccatccgcaacgtgaatatgaatcgcggcatccacttgataatccgcggtcgttttcaacatttttcctgcatcatcggtgacaaacgcaaagccgcggcccaatattttcaacggacttaaatgatccaagccaagtgccgcattggccaccgcttgatgcttagcggtcacaagtgcgatcattgcccgatccagccgacgccgatcatccacctgctgccgctgcaggttggcgacttttaccagcaactgccgaccatccagttgggcagtcgccattgctaaccgatgcttgttttcgcgtaactgattgttaatgctctgctgcagccgttgtcgtagttgatcgacacgctgaacatattgatcgtaaagccgatccggttgggttaagacaacgctttgggcggatcgttgtaagcgtgttgctgcatttttcaagcggttatgcatggcgtttaccagtcgcacctgatcttctgagatgcgattcaaggcatccaccaaagtgactggcgtgacaatttctgcagctgcggtcggggtagcagcacggcgatcagccacaaagtccgcaatcgttgtgtcggtttcgtgaccaaccgagctcacaatcggcattggcatctcagctagtgcccgcgctactttttcttcattgaacggccataaatcttcaattgacccgccgccacgaccaatgatcaccgcatcaaatccggacattgtcttaatccgattcaactgtttcacaatcgaatcggccgcctgatccccttgcacgatagccggaaataaggtcaactgcagtatcgggtatcgccgggccactgtggtgataatatcttgaatcaccgcgccacttggactggtcaccaccgccacgcgtttagggaaaagtggcagtggccgctgatggcgttcaaataacccctccgcagccagttttttctttaattgttcaaacgcctggtacaaggcaccaacgccatctggctctaatcgctctacaatcagtcgatactcgccgctgggttcatacaggctaacgcgaccaaccaccaacaccttcatgccttcttcaaggttaaattgaagtttgctgaatgcgttacgaaacatgagagccccgattttggcatgatcatctttgagtgaaaaatattgattgcccacgcgtttgcggtagttggaaatttcaccggtcagataaactttggctaaatacggatcggcatcgaattttctttttaaatactgcgtcagtgcggtaacggttaaatattgacttgtctcaaccatgtaaccgcctcttcgccaaagccaccgtttgggccatgagcgatgcaatcgtcatcggccccacgccaccgggtactggggtcaaggcgcctgcaatcggtgcgaccgtatcatcgtcaacatccccatgcagttttccatcggcaccgcgggaaattcccacgtcaatcaccgttgcgccgggtttgacggcatcagcgccgataaaatgtggccgtccgacagcaaccactaaaatatccgcttcccgcgtcaactgtttgaggtttcgggttttgctgtgagcgatggtaaccgtcgcatcatgattaaccattaatccagccagtggccgtcccacaatattcgagcgcccgacaatgacaacccgctgcccggcaacatcaatatcataagcatccaacagcgccataatgccataaggggttgacgccacaacggttggctcattcgtccacaaccgtccgacactaaccggactaaagccatcaacatctttattaggatcaatcgcatcaataaccgcgcgttcgtctaagccagcaggtaacggaagctgtaccaaaatagcatccacatcaggatcctgattcaactcggccaccttagctaacaatgtcatctgagaagtgtcttctggcaatcgatacatcaacgagcgaacgccaatttcttcagcccgccgctgtttgttacgaacatagacttcgctagcaggatccgaaccaactaaaacaacggccaacgtaggcgtgacgtcttgttgtgccagttttgctaccgtctgtttaagttcaccaagtattttctttgacactacccggccatctaatcgcgttgccacaaaaaccactcctcatttttgacgctgctcgcagcagacgcccgatgttgtttgttaccttgatcgttaaagattcgcggataaattaaaaccggtcaaagtaattgcctttgaccggttaacttacgcttttggcgctgcttcgatgaagtttgccaaaatgccattgacaaacttcgccgactgctcgtcgctgtaacgtttagccagattaatggcctcattaatcgctgcagcttccggcattgcttcttcataacgaatttcatataagcccagacgtaaaatgattaaatctggtttcgttaaccgactcagcgtccagcctttttttagttgcggcgtcaaagctgcgtctaaggctgcttgatttgccaaaacgccttcaactaatgccgttaaatatgacggtacttctgtatctttaggtaaaacttcggcgtacaccgcatttttatcagcttccggattcgttgccaaggcaaagagcgcccgaaaggcagcttcacggattgcatgtcgtgattccatcttattcgtcatcctgtccgctttttgtcgctgcatcatccgtgtcatctgtgtcgtcatccttaaacaggtcttccggattgactggctcggtcttttcgggaatcacaccaacgacatgaacattcacttcatccaaagtaagatcggtcatgaatagcaattgctcgcgtaactgctcttgcatcgccaatgcaaccttgggtaccgaaacaccataatccaaatagacgtacacatcagccgtaatcttatcatcggcaactgtcacactcacacctttaccgtgattagcccggccaaaccaggcattaatggaagatcctaatgtgccgcgcatttggtagaccccgtccacttgactggcagcgatgcccaaaatgacctccaaaacttcaggaacaatttcaatcgtcccttgtgcatcagtccgatttgctaatatgatattggtttcttcagccattatgagatcctcctagccttagttgttagcacgtgagatataagtgccatcatcggtgttgatcgtcaacacatcaccgttattaatgaaaaatggcacttgaacaaccaaaccggtttccatggttgccggctttgaaccgccgctactggtgttgccgcgaatacccggttcggtttctttaactgccagatcaactgtttttggcagctcaatacctagcgtttcattaccgtgcatgataattttaacattcatgttttcttttaaataattcaactgatcccgaatttcgtcacctgggagtgtcagctgatcataagtatcggtgtccatgaatacatagttgtcgccatcggcataaagatattgcatgtttttgctatcaatctgggctttttcaactttttcagtcgaacggaaggttttttcctgaacggcaccggttcgcaggttcttcaaagtcgaacggacaaatgccgatcccttacccggcttaacatgctgaaattcaacgatccgccaaaggtcaccatcgacctcgatcgtcaagccatttttaaaatcattaacagatatcatgaacttcctccatacattcagtcataaactaaacctattctagcaagcagcggagacgcttgcaacagccaccggcgaactaaccccaatgatctgcagtgcatcaccacacaaagcagccgtctcgatacgaattttgccttgatataaccacccatatcagagataggttcgaaaaagcggtcgaataaactgcgaccgcaacgctattcaatattcttatcagttatgcctttgactatctcagtagcaaccggcgacacttttaaatgttaaagtaccaataaatcagccggtgctggttgactgagtgattgattaccgtcagccgttaccaccagatcatcttcaatgcggacaccaccaagctctggaatatagatgcccggttcgtctgtaacaacattaccttttgcggctgggacgtcaagatatggcccccaagcacccgggccttcatgaatcgataagccgattccgtgacccgttccgtggccaaagtactgaccgtaacctgcatcattaatggtgtgatgcgccaaatcgttaatcgtccgtccgagcacacccggtttcagcgcttgttgcactttttggttagtttcgtaaacaatcttgtaaatcgtcttcagcttaggatctggctggccgactgcaaaagtgcgggtaagatcggacatatagccatgataaatgcagccccaatcgagcgtgaccacatcacccttcgcaattttcttttcggttgccgcaccatgaggcatggccgagcgggcacctgaggccacaatcgtttcaaacgagacgttgctggcaccgagtttgcgcatataaaagtccaaatcattggcaatatcaatctcccgcatgccgggcttaatggtcgccagcacatgttgatagcctttttccgcaatggcaacagcctgtttaatgagagccaattcatcatcgtctttaacttcacgctggctctcaacgaaatcgcgagttggcaccaaggtcccttgggtcaacaagtcaaacgcttcataatctgcatagttgagatgaacggcttcaaaaccaatgtgcgttaattgcaaccgattggccaattttcccgccgccttaaacagcccatcttgatgcaaaaccaattcggcgtgctgcacctgctgtttaaattgttcggtaaaccgcgaatcagtaataaaataagctttttccggcgtcaccagcaaagcactttcatcgccggtaaagccggtcaaataagtgacgttggcggcatcggtaacaaaaaagccatccagtttcttatccagaatccgtacctgtaatgctgtcattcgatccatccaaatcgctcctttttgacatttttccaaactttgaaaaaaagacgccccgttttaccgggacgtcatcaatctttattcagcagctgctgccggataaactgaaaccttcttcttatcacggccgaagcgttcgaacttaacaacgccatcagcggttgcaaataaggtatcatcgccgccgcgaccaacgttttcaccaggatggatcttggtaccgcgttgacgatacaagatgttgcctgccttgacgaattggccatcggcacgtttgctgcctaagcgccgaccagctgagttacggccgttggatgttgaaccgccacctttatggtgagagaagaattgcagattcatctttaacataacgtacacctccgagaattaattttgctctaattgttttgtcgtaatcattaagcgatcagggtattgatcttggatgctttgaagttcaagcaataaattttccaacaaaatttgactaatatgcaactgttcaccggtaataacggatttgagcttcatttgcaagtggccaccatggacctcatctgcaatgacatccggcttgaatcccgctaaggcttcaacaccgttaaccgcaccgatactaacagctgaaacagcagcgcagacgatatcctgaccggttttaccggcatcggcatgaccaatcagctcaaaactgacaatatcgccatgctcgtcgcgatgaaaaattgccttgatcatagcctaacctcttatgcgttaatcgcgtcaataacgacttttgtgtaaggctgacggtggcctttcttctgatgagagtgcttcttaggcttgtacttgtaagtaacaacctttttctcgcgcccttgtttttcgactttaccggttacggttgcgccggcaacggttggtgtgccaatcttggcatcgccttcgccagcaaccataatcacttcgtcaaaagtaacctgcttgccttcttcggcatcaagtttttcgacataaatggcttcgccgacttctgctttatattgcttgccgccagttttaataattgcgtacactgtgtgcacctcctgttttgcctctcggcttttcccctgaagactcgccaagttaggtgcttgcgcttaaaacctaacgatgtgcggttgcataggaggggtgccaaatacaacggattaatactaccagagactggggtaagttgcaagcgtctatgtaagtaagtaaacaagttcattttatctattggcttcgcgatccaatcccaatatcaggactcccaatgccatctgcttaaacggaaatgccttacgatgccaaatgccgtttacgataaacccagattccgcaaatgagggctggcatatagagtgcataaataatagtaaataacgtgagccacccgccgaaagccgcattaactaacagtaacccaacatataaaatcccgtcgataatccagttaaccggttctatcagttgcgtggtcaccgtgattagcaacgccccggtgactaataaaataagaatatcgagcaaaataatcatacgcgccacctcctgcaagcattatagccaagcgtgccggtttcaacaagaaaaccttgaaatctgacctccggcgttttgttgcatagaaaaaggcccagaacgaatctgagcctgcccctgccaagatacctaatatagcataaaaggcgccaatgtaaccagcaaatatttaaaaaggcaggggctaaaaaacaatatcttagtgaccttaaacatgcctcaaggaagtgaaacatcaggccaagcttcacatgcctgccccttatcccctgaaagtagctaaagaaaagccgctgatcattaaaaaatcagcggtgatgagtcaacgtttcaactgttgtaacgctttttcaatcgtatcgcctttgccaacatgtttggcatttttcggatcaatggcgataaactcttgcgttttcatattaagttggattcgatatgccatctgaatccctccattcttaaagatgtgaatggcctttggtagcgaataccgtcatgctactcacttttaatcagtaagtcaagccatccaacttcaaaacaacccattagcaatcagggtctcgttatgatgacatccgggtttgaatttaacctaaaagtccaaccggccgggcggtttcattgacttgaccttctggctatggcattaatggattaaagctttttatagtttagtcagtgatagcggattatcaatatttttatttttaggggcgtggaaattttgaaaaaatggatctggggttcaatcggcgggctaatcgttttaattgttgttggcattggcggatggtggctttatgaccattttcattatcagcaactagttgatcagcctgctgacgttaaaaaatgggaagccgacccacgcccactgcaatctgaacaaaccgccgttaagcgaatcacggaaatcccccagtcggcacaattaggcaatcggatcgccaaggggacaaagttggttgtgattcccgggctgcgtggcgcctggtcaattaacgcaaaaaccaaacgcgccggctttggcacaaactgggtccctcaaggcgttacccagtcaaaagacagcctgttcgtcagtctatacgatggcgatcacaagttaaattcgctgatcttggaaatcaacaaaaaaaccggtcgttaccgtaagtcgtttattttaaagtccaaagcacacgtcggcggcatcacctatgatcgcgaaaaaaagcggctgttatggtcagacgacaactccaaactcggtggcgccgggattagttatgcctctcaacgagcacttgatgcgtatcaagctcaggttgaaaaagcgcctctcgattccacgcgcatcccactgcacttggctaaccggacatcggccatcacgctttatgatcaccaacttgttttcgtcaaatatggcaagaacgccattaatcggtcgctcattgctttaccagtgaacgatgacaacctccctgctgccattaccgaagcacaatttaaccgcttgattcgcgaccttatcccgcaacttgaaggtaaaaacgatacccaaagtttccaaatcatttctaagaagctcatggatgacaagatcatcaattccgtcaatgcaggctgggatcgcattcaaggtattgccattgccaagaccggcctcacctttgtcagtcaatcaaatggtgccaagcccggcaaaatctggatccgtattccccttgataaaagttggtctaagctaacctttgccacgccgaaatccggagacaaaattattaacgttcctaattcggtggaagaaattagtctaaacgcggatgacagccagctggcccttatttttgaaagtggtgccaaagcctatcgcgaagaaggctcgttctggaaacgcccgcactacatggatcgtatcatgctattgcccatcagcgtccaatcaaatacaaagaaatgacctgattatcggcttatcgcttcatggcaaaatgcaagaacccgttgacggtctatcccggttctcgtatacttaacaacgatttgtaccagtagctcagttggatagagcaacggtcttctaaaccgtttgtcccgggttcgaatcccggctggtacattattaaagtaaaacgggaaaagctaggacaaagagcaggaaaagaattttttgccagtgagctaaaaaaacatgcgagaatagtcctttctatcacaaaaatagcaccggctgtacaccctgcgacataaggtatacaaccggtgctattttgtcattttttcaactgcaacgtatgatcaaccaactcgtaagtttcaaccccaaactcctgcgccagttccgcattataatgatgagcaacttcgatcaccgtcaccggcaaggcataaataagcttatgaatcttgtcggcatttgcctgatcaaggctggcagaaatttcgtctagtaaaaagaccggactttgtcgcaagaggccgcgggcaatcccgattcgttgtgcctggccgccggataaattgctgccgttatcaacaatttcaaagtcaagaatgccaatacccagttccttatccaggcccacaacctgcaagacccgtaaaacggcttcatcgctgtattcctgatacaaggtgacattatcccgcaacgtaccactaaacagccaaacgctctgtgaaaccaacacaaagtcaccggcatgcagcggcttattgttaaataaaaccgttccctgcgcagtaagctgaccagtgatggcttttaaaagcgttgattttcccactccagaaggcccggttaccagaatcttagcatccggtttaaggttcaaattgaccgcgtccaaaattaagtgctgatcacggacaacggtgaggtttttgattgttaaatgacctttaacgctttcaggctcagctagcgttactggtttttcatctgcaatcggctcagaaaatgctttaacgaccggcaactcgcgtagttgacgcgttccgataatctggctttgatactggctcaactgacgaacaccgtacacaactgcatcggctgtcatcgtcaatgtcaggatgacacctgtcgtcaccccaaaccatccctgcgccatgaacaaaagaccaataaaaatcggtaacaaatttgctgcaatcgcaaacatccaagaaatgaactgcaagaaatactggaaattgttcagtcgttcgtaatcttcttcttccttggcaagatgctggcgaaagcgattaaagaatgcctgccatgcttcaaagttcaaaatttccattcgtccttgaaatatatctttcatattcaagaccaatgacgcattcgcccttgaccaagcacgcgaatttttatctaaccgtttacgaccgaaatgactcggcaacaacgataagactgaaaaaaacacataaatcaaacttaaaatcgcgttgatcttcagaataaagatgaccaccacaatcacgccaaaaacttcctgaaacatatccataagcgtaacaaaataattttgctcaatttgcttgccaacactggtgacctgattaatggtgtcagaaacctcggttaccttggtaccggcctcagccattgacgttgtaaagtagacggttttcagcgcctggttcaataatcgaacagcacgctgcctaacacggttgtatagatagagcgaaagatatgttgaaaaatatgctgctgttgccatgagcacatagcggccaacaattcccatattatgaaaattaatgtctgccaactggccgaacacccagccatttaatattggttcaaacgtacctacagcgccaaaagtaaccagtgccaccatcaatgaaaacggtaattgtttgataacccagcgcacaccaatccgttgtgcttgatgatccgccattcagttcacatccttgtccttgagtaacttcaatcggcaactcgcaacttttaatcgtgtcgcttaaatgcgaaatggcagggtcaaggtacttttggccaaatccagctgataatgggtgacttttgtcggccgaatcgtttgcgccatatcagcaccatgaataatcagtgccagttgccgcccagccggtaagtgataatgcgttggctgcaaatcgagactcacatggaaaaactgtccaggcgtgatggtttgaacttcatacgcattttttgggttttgcaaattaatatgacccagcgtgatcaatttgcttggcgtttccttattggccggtttaaattcaacaatatccgtggtcttaaaatcaaatcccaactgcaagccacttgcccccaccgttgcggcattttcctcaaagcgcttggccttacctaaatcaaccagccgcacactgagaatgccggttggcgcatcaacggctagcgttaactcaagatgcggaatgccttctaagacccgatcatgctctaggaccggctgagtcaaccacagacgactgttaacataggcgctattaggcgtaataattgctttttcaaaacttgcactcgtatcatgttgggccgtgaatgttgctgtcgcatgatccgaaaattgatcggttgcgctttcaaaatcagttttcaaattagccgtggttgtcacatgctcagcagctgggttcgcaaagtccgaataagctgaccatgtctgcggcgtcacgttatcctgaaccaatacattcggcaaaacctgctctgcctgattggcaactcctaataattcatgagtcagccaaagattcatcatgtccagaaggtccaaggaacgaacattgtgcacgtagacatgctgaccttgatgcaggatcaacttcttttgaatcggtaaatccgcaattgcctgccagaaccgaatggcgttctttggtttaacattccaatcatttagcccgtgaatcaggaccacatccgccttgacattagccgcgttttttcggtaattccgcgcgtcccaccaagcagtgtaagcgcctgttgtccgatcctgatcctgggtcatttgtgccagatgctgttcccaggcctttttaaggcgaatcatatcgccaccggatttttgccgtgaaaaagtatcaaccgccaatacgtcggcatcttcaccttgatagccacccggtgccacaacgagaccattttcgcgatagtaatcataccaactcgaaatcccggcatcagcaacaattgttttcaaaccttcgacgccggtggttgccgctgcaatggccagtgtcgccagataagacttaccggtcatagccactttgccactcgaccaccacgccttaattgcaaccccatccgtgcgattggtaaaagcccggcgtttacccgtcagccattcaatcacggcaactgccccatctgtttcttccggtccgccaattgtgcgaaagccatccgaataacgcgtcccgacaccagctgaataaacaaccgcaaagcctcgcgccagaaaataatcattgaaggcatatggactattttcctcagcgtatgccgccgcctgtttcgtctcacctgtcaccggtcgcgctggcagttctggtttggaagccggcgctgcggtgacttccgccttcgaagcgccatgtggtttaaccgccaaaaccgtttccggaacatgcgtcgccgcggtgacatcgttggttccatgaaagtaagggttagcggtaaaaagcaccggaactttcagcccgcgatcggtggctttgggacgataaatcgttgcctcgagcagatcacgttggccgtcatggtcagaatctacatctgattcgatccagacaacctcccgaacagcttgacgcgcatcaaacacctgttgcaccttgccattaaagagcaaatgagccggttgcgaactttgagcctgaaaatccttaaaaaaaccgcgattggctaaatcatccagaaagctaaccaagtgcttggtgcgcgtggtcagtaacaggtagctggcctgaagcaaatcagcagtatgtagcaaatcatgcgcaacactcggtagttttgttacagtcataaatgaaatcggatcgcttaaatcaaagtccgaaaacgcctcaaagcccaagagctgtaacgcaacattataaaagtctgcccgcttcatttgagtgggctttgtcgccaaccactcagcaagattctggtgtgcattaaccgcaacctgagcaaacttatcctgttgcgccgcgggttgatatgcctcagggaaaaaggctgcgtacatcgcagctgcagtatccgcaaagggtgcttgcggatcggcgggtaacccaatgcgtgcgagttccttcaattgttgatcaatatcaggcgttaaccgagcaaactgatttaatttcatgcgaaaaccttccttttatgagagtgagcgcgagccagcgcggttaggagccggagtgtaagtggccttgggcgtgatggccgggctttggccagtgcgatcaaggtccttacacgcaggttcctgcgctggggagcgcgttatgataagcgcgagccagcgcggttaggagccggagtgtaagtggccttgggcgtgatggccgggctttggccagtgcgatcaaggtccttacacgcaggttcctgcgctggggagcgcgttatgataagcgcgagccggcgcgcttaaaagtcggagtgtaagtagccttgggcgtgatggccgggctttggccagtgtgcgaccaaggtccttacacccaggctcctacgctggggagcgcgttatggtgagcgcgactcagcacgtgtatgaacttaacaaagcaccaagttataacagcgtaagatgagagaaatgtgataaacacagtgtagctatctcatttagtgttttcaactctaaaaatattttaaattaaatgcaaaagaaggcttcagacgtgtttttctgtctgaagccttctcaatattgttaaatgcttgactgttttagctagccagcagttcgggtgccaacaacagcttttgggtggctgaacttaatataattccaggtattgttgccgttcccattcagaaacctgctgacgataagcagaccattcgaggttctttgaatccataaagctttgatacaaatgtttacccagggcagccttgaccacgtcatcagccgccaatgctttcaaggcattgtgcagcgttgatggcaggtcttgaatatggttcgctttacgttcgtcatcttgcatccgataaatgttacgatctaccgcttcttccggcttcaactggttcttaaccccgtcaagaccagcttgaagaatggcagcgatcgctaagtatggattggcagtcggatcaaccgagcgcaattccaaccgggttgataagccacgtgattgcggtacccgaatgagaggtgaccggttcttgccagaccaagcaacataaaccggtgcttcaaacccagggactaaccgcttgtaagagttaaccgttggattattgatagcagttaacgcataggcatgtcgcaacacaccggcaagaaaatgcatcgccgtctcactcaattgatcgcctgtatccgggtcaaagaatgcattgcctttgtcgtggaaaagactcatgttaatatgcatcccgctaccgttgataccatgaagcggttttggcatgaaggttgcatacagaccgtgtttgcgggcaatcgttttaacgaccagtttgaaggtctgaatattatcagctgcttcaagtgcatcggcatacttgaaatcaatttcatgctgaccaggcgcaacttcgtgatgagatgcttcgacttcaaagcccatcttttccaattcaaggacaatatcacgccggcaattttcacccatatctaacggggcaaaatcaaagtatgaaccacgatcattcaagtgcgttgtcggattgccgtcttcatctaatttaaacaagaagaattctggttcagggccaatgttaaaggctgtgaatccggcatctttcatttcattaacgacccgaatcaagttattccgcggatcgccgccaaaaggtgtgccatccggacggtgtacggagcagatcaggcgagcaatcttaccgtgatcattctcccaagggaacaacagccaggtgttaagatctgggtaaagcagcatatcgctttcttcgattcgaacaaaaccgtcgatcgaggaaccatcaaaggtgatcttgttattgagcaccttttccaattgtgaaatcggcacctcgacgttcttaatgatcccgttaatgtcggtaaacatcaggcgtaagaacaaaacattttcgtccttaactgtctggcggatctcatcagcggtaattgcttttcttgccatatacgtgaactcctatctttagtgtgattgtcggaagccaatgaccggtcctggatccgggctttgattcagtcggctttgattcagcagttcatcccgcaacaccttccgaacttctgcatcactatcttcacggtgacgcggatgttttagccgcttgacatcagccaacgtaaaaccgtcagccatttgactgcgaatctcaagtaattcgtcaacatcatttagcgagtatgttcggtgattaccggcgttgcgttgtggcttgaccaacccttgagtttcataataacgaatctggcgggcggtcaaatcagtcaacaacataactgtaccaatcggcaagaccgatcgcgttctcagatcagcgatctcagccataggcatcctcctttacaacgatgtcagcttatcaaaccacttaacacctgtcaacgccacatgtaaggttttcttacatttatggttaaattcggtatatttttatttttctttttaatcagttatagaccaatagcgaaatgtcaacgcgataaaacttccctttttccggtaaaatatttaagcacgtgcgaggtaagtccgctatcagtaccttagttaaattttttggggccagcctctaggtatttttagtctcggaaagtatgataactatagtctgatcattcttgaaaggaagttacttccatgacgttacatcttcacgttggttataccgccagcttatcatccccggacataccggctgattggctgccatttgcctcgcacccacttgcggcatttgctgctgtcgttttacgggctaccgatcatcaggcgctagcacagttaaatgccagcgcgctccctttgcctgtttttgtgatcggtcatcttgagtacgctcctgaaagtcaattaaaaatcaccccaatcgagcggttagatactacgagtctggctcagattcagaccgctgcaaccgagtatgagtctgccatggttcccggatttttacgcgatttactcgcctatgctgcggctgaccccacaagttttgcaacgccgggccatcatagcggtcattatgacgaacttgcgccagccggttatctattgcaccaagcgtatggcgaaaccttctttgccagtgacaccagtgatgtggtcactgcacttggcgatatgctaacacatgggggaaccccgttagcagcagagcaggccaccgcgcgcctataccatgctgatgaaacctactttgtgaccaatggcaccaccggatcgaacaacattgtggccagcgcgttgttgacacccggtgatctggtcttattcgatcgcaataatcataagtccttttacaacgcagctttagtccaaaatgatgcccgtccggtttatttggacacactgcggacgcaacgtggcttgattggcccggtcgatctaaccggcattaccggcgagcgactacggcaactcgcggcaaccgttgaccccaaaaaagcaaacgaaccccgaccatttcgcctggcgattctcgagttggaaaccttcgatggtattgtgccaaacgtgcggcaactgcttgatctgattggcccgctggttgattacattgcatttgacgctgcttggggcgggtatgaaccgtttatcccggctatgaaagcaatggatccgctgcagttgcaacttggcccagcagatcccggtatcatcatgacgcaaagtgtgcataaacagcaatccggctttggtcaggcttcccaaatccataaaaaagacgcccatatcaaaggtcaagcccgctacgtcagtcatgagcagttcaatcacgcctacctcaaacacgtcaccaccagttattcctatccgctttatgcgtcactggtgaccaataccgcaatcaatcaaggcccgcgtggcaaaaagatttgggctgatgcgatcacggcttcactcgaatttcggcgctccctaactgactcccgattattttcagcctatgaaaatccgcagttagcaaaaacaccgccaaccgctgcactaaccaccagtgacgcgtgggccatgacccctgacgcttcctggcaccagcttccacgcctacaacccgatcaagcgtttcttgatcccggcaaagtgacggtcttgctcccagcgaccgcggaattaggcgtgagtggctggctagttgatcgctatctgctagatcatggcattgttcctgaaaaagcagatctgaacagtttgttgtttctggtgacgcccggttctgacaaggctgattggcaacggttgcgccaaggattacgtcagtttgaagcagattattttgcaaacaaaacggttgccgagacattgccaaaactggtggcggaaactggtcaagcctacacaaacctgactttgcgaacactcggtcagaaaatgtctgactttttccgccaagcgaggttagccaagcagcagcaactccttttcagtgcgaccaacaacattccaacggccatgacggcgcaggctgctgatcgctgtttcgttcgcggccagtttgagaccattccgttgcaagctgcggctggacggatcgcagttgccggggccttaccttatcctccgggaatttttgtcgtcgtccctggtgaacgttggcgaccagaagcaatccagtatttcgaaaccttatttgccgggatcaaacgcttcccaggatttacgcctgaaattcaaggggttgtcacaggtaaaaacggcgaaccctatgtgcaggtcgttgcggacaaagaataaccgcttgtcaatcgcacgagtcgcaatagcagcatctagtcaaaaaaaacgattccagcctgcgcaatttattgcaaggctggaatcgttttttagtgtcctgtgttttatattagtcagctttgtcaaagaaggtcgattgagccgcgcccatcgttgcaagtttaatgtgggcgtaggttaacccaccttgcagataaagcgtgtacggtggtcgcagtgggccatcaccggaaaattcgattgtcgagcccgcaacaaatgtaccgccagccatgatgacttcatcttcataaccagccattttctcgggaatcggggtgacgaaactgtcaaccggcgaattggcctgaaccgccttggcaaacttgatcatgtcgtcacgattgccgaaattaacggtttgaattaaatccgtccgcggggcatcccattttggtgaaacgtctaggccaagtttggcaaacaaggctgcttcaaaaatagcacctttaatggcattgcccgtggtttgcggcgaaatgaaaaagccttgatacatgtcagccagcgcgccaaccgttgcaccttctgcaccgccgaggcctggcaccgtgaaccggtagctaatgcgctcaatcagatcttgcttgccgacaatatagccaccggtcttggccatgccgccgccagcattcttgaatagcgatcccgccataacgtcggcgccgacctcaagcggttccttggtttccgagaactcaccatacgcattgtcgacaaaaatccagacgtttggcaacacactgcgaaccaccttgatcatcgctgcgatttggtcaaccgtaaacgaatcccgagttgcatagccgcgtgaacgctgaatagccactaccttggttttcgcattaagccgggctttaaccgcctcgttatcaaccgcaccatctggcaaaagatcgacataatcaacgccaatcccgtattctttaggactcccaatgccattgcctgccagcccaagtacttcttgcaacgtatcataaggtttgccggtaatatagagaatctcgtcaccgggacgcaccaaccccagcaaagctaccccaatggcatgagtgccagatacaaactgtgggcgtactaacgcgtcttcaccgcccaaaacgtcagcgtaaatctcttcaagcacatcgcgcccttcatcgttgtgcccatagccggtcgaaccggttagatagctctcagcaacatggtgtttttggaaactggtaagaaccttgtcctgattttctaaaatgcggccatcaattgcggccagttgcggtgcaatttgcgtatcgacttctttaaccatttttaataatgcgggatcaaatttatctgtccaactcatgtttttctcctttagccggttgctttagccaatcacgaaccaaagcaacgacagcagtcttttcttctggatgggcaaccaagtcaaaccaatgtgttggcatctggttgcgaaaataggtcagttggcgcttggcaaaatgacgtgaatgctgtttaatcaaggccacacaggttgctaaatcagcttgcccgcgaaagtacgggatcaattctttgtagccaattgcctgcagcgcctgcgcatccgggggaaccgtttttagcaggttggcgacttcattttctaagcctgctgccatcatagtatccacgcgcgcattaatccggtcgtacaaaacagggcgtgctgtcgtcaaaccgatcaccaacgtctcatagcgtggttgcggctgcggctgctcggaaaagcgcgtacctgtcaattcgatgacttctaaggcccgaatcacccggcgcgtatttgccgattcaatttggttagctgccactggatcttgctgctgcaactgctcccacaaccagtgttcgccattttctgccaatgctgcctgccaacgctgacggactgcagtcggcggtgccttgccacccagcggtaaattcaggcgcaaactgttaaggtaaaagccggtgccgccaactaaaatcggcaggtggcgccgactgctgacgtccgtgatggctgcctcagctgcggctttaaacttagcaactgaataggccatctgcggatccacaatattaagaagatggtgcggaatgccgcccatttcatcaggcatgattttagctgtgccgatattcatatgccgataaatttgatacgcatcaccattaatgacttcgccttgcagttgttgagccaagtagatgccaagatcgcttttacctactgcggtcggtccaacaatcatcacaatgcggttagccggtttatccatttcattaagctccatgagtatagtataattacagtagtatcacagatcaccaatcaggggggattttcatgaaacataaatttgcacgtggctttttcgtcggctcgctcatgactattggcgctgttgccggcagtgttttcgccttcaagaaaaattatatcgaacctgttgaaaccaaggttgacgaaatcaacgaaaatcggcgcaaagccaatcgtaaacgtttttcggcccaccaaggctaaaccattgattgatcatttttaccaaaaaagcaatcgacttgagcgattgctttttttgctgtctatgtacggactaataattagtcggactttttttgattttgcctgaccaattatcatagccgccttttaaccagctgattttttcaaagccgtttttacgtaatcggcgtgctgctcgcaacgacagtacacccgtcttgtcgtatagataaaccggcagatctttgcgcatttcacctagccgttcccgcagttgggtatatggcaggtcacgtgcccccagaatatggccggctttgaattcgttacgttcacgcaaatcaataatctgagccttacgcatggtgtgttcgaatgtttccggactgatttcgccgccgattgctttaaacttcgacttttggtagtaactccacagccagctaaagccccagtaaattaagaataatccaacaatgatcagtaaataagttaacacgtctctgactccttcttccgcttacttcagtgccaagcttgcagcaccgataacgccagctgtattccccagtgtcgccaaccgcaaactagtagtttcacgaacattcgggaaggtgttttctttgaagtacttgtcgactcgcgtcagcaagaattcaccggccgcggagacaccgccgccgataacgatgaatttcggattcaaaagattgccgacattggccaaagccaaaccgaggtaaaaagaaacccgatccacaatcatcaacgccagacgatcgccttccttggccaagtcgaaaacaattttgctcgaaatctcatcgccatcgtccaaggtttcttttaacttagagtcgccggcaaattcttctgccatgtcacgcgcaactcgaactacaccggtcgcactggcaactgtttcaaggcaaccacgtttaccacaggtgcaaagatagccattaaccggatcaacggtaacatggcctagctcaccaccggaaccggcaacaccatgcaagagctcgccattggcaataatcccgccaccaacaccggtacccagcgtgacaaacgtgacatcaggatcgttttcaccggcgcctttccagcgctcacctaacgccgcaacattggcgtcattatccacgctaaacggaatgccggtccctgattcgattatttttctggcttgctgcaaggttttccagtttaggttgtaagcaccgataattgtgcccgcctcactgtccactgatccaggcgaacccatgccaataccgacaaaatcagccggggtcatcttgtataaatccagatgttcattaatagatgtaacaatgtccggtaaaatatggctgccttcatccaaaatattggtgtcaatactccacctttgttgaatctcgccatcctgcgttaaaatggcaaattttacggtcgtcccgcctaagtcgacgccaatcaatttttggtcattcatgttgatcattcctccgttgatccgaatgcaacggcaattcatgatttaaaggatcccgttcttcctgttcatgtgcatgacgcagcacaatttttgcattcagatacaccttatcatcaatcaattttgcctgatgcaagcggtctaattcaagtgccgcaagttcaatatcccaaacacgtttaccaacatggatatacgtgccaaaaccttttaataattgcaagacatcatagtaagttttcatacgattccgcgctgaattccaaataaaagcaaagcaaccaatccaaagatcaaggttatcgtagaggccagtcgccggccggtgctcatgcgacccaatgctggcgctcctaacatcccggcagccaagaacccgccaagcaagccgccgatgtgcccataaatatcaacgccgcttgaaaacaaattaaacgccaggttcaaaaccacgagcagcaaaaactgccgtgccagctgacgaataaccggattctcccggtaagtatcccctaacatcaagcacgcacctaacaagccgaaaattgctgtactggcgccagctgccaacgtattgggactgaacgcaaagctcgcaacattaccggcaaatccggcaatgaaatacagcaagaaaaagcgccagtgaccaaataacctttctgtcatttggcctaggaagtataacgagaatccattcattaaaatgtgcgtcaagccgatatgcacaaataccggcgtgatcaagcgccaccattggccgtacaaaatcagcggattggcccgcgccccatatgtcaccaaaacagcattgttagtgctgccacctgaaagtgtctctagaatgaagaccaaaatggtaaccgccaaaatgccgttcgtcacataggctgaattttgaaagcgagagcgccagtttgcgtaattcattaaattcctttctaacttcactgcaatagcagcaagtgcgtttctgactgccgaatagttggcttatatcgctaaaaaaacaacaggtgaacctgttgtttttccccgccaccgctgaccatcaatcttctttggtcatgtcttgtagtagtttagcattttttgcacacgctgccaacagcgttaaccgttgactgtcttttgatgaatcgagtagcccttatcttctttaatgtcattcatcttgtagaagtcgctaaacatttccttagcaatttgtaactggtacggcgtggttgtttccgcctttaggttcggaataatgacagcaatcgcgattttagggttcttggccggggcataaccaacaaaactttcagtaatggtttcggttaatgccgagtcgtctgattcgcgcgcaaagccttgcgcagtaccggtcttaccggcaacgcctggattaagcgtatttaaggaagtcgcggtggtccaaccattcgtaccatggacaacctgccacataccttgcttgaccaaatcaatttgggcctgcgtattttcgattttcgaggtcaccgatggctgtgtggaactcagcaccggccctttgctgccatcgcttaacgtttggctgatactgttaaccaaataaggccgcatccgataaccgttattggcgattgcgctgatatattgcagcatttgaatcaatgtatagttatcgtagtttccgtatgacaagtccaaagccgacccgaccagcaaattacccgaagaatcatgggttttcccttccaacccggcaatttcaccgggaagatcaattccggtcttgatacctaagccaaactgactgaaataaccgcgcattttggtgaaaatgttgtcgtccattttcagataattgttcggcgaataggcatagtgaccttctttcatggccagccacatcatataaatgttactggaaacttccaaggccgaggcagcatccagtgagctgaaagtgccaactggataaactgacttcttcactggggttgcaggcagataaatcggggtatcttcctgggtattatgctcaacactaataacgccatcttgaagtgcccctagcacagttgcccctttgaccgctgacccgacaacaaaagcgcggttaataacccccagtgcatcgtcttcaacttttttggtcttaacatcctgatgttgcccggccatcgctagaatccgaccggtgttaggatccatcgctaccgcataagccccatcggataatccgcctgcgccagccgaacgaatcgaactgaaggtgtcttcaagcgctttttcgaccttcttttgatattcggaatcaattgtcagattcaggttagcgccttgttgacctttaaatttcgacactgactgaacaatctgattgtcattgccaatttcaacttgggtctgactctttgaccccttcaaaacattctcgtatgccttttccagataactggttccgacacgatcattacgcgcgtaaccgttagccagataagcctgcaactcgtcagccggcaacccgcttttttcattggatacccggccaatgatggaggtcattgacgtaccgttgggataggcccgttcccaatcggtgcctaaattaacccctggcatttgcgtcagacgttcacccacaactgcaacttcatgtgccgttacattctggtttttaagatagacagtcgatagttgggtggcaccgttcataatcttgtaaagaccggctgcctctttttcaattggggtcaacgttggcatatgtttgcggacataggcgacttgatatttatacaattcatcggactttgatgacggtagatcctgaatttttttaggtaactgcttcgtcacctgcttggcaatcttggttcgcgccaaatagtaatcaatgtaatcacgcttagtcagattctcggccggcttgtcaattaacttggccagttgattggcgatctcgtacatctgctgcgatttggtacccacacttttggtataagtaatcgcattattggctttattggtcaccaatgctcggcctttactatcaaaaatcaagccccgcggcacattcccggtcaccacggttttattcgttcgatcgacttcggcagctaatcgcgggccatttaaaatctgcaaataagccagttgggcaactaaggccgctagcaaaagaaacgcaatgaaaaataataagtttaagcgaaacggaatgcgactcttattccgcttcggctgcggtgtacgaatgtacttcacctaaaattgctccttcgaaatttctatcttttaaagtgtagcaaagaacccgccaaaacgctatgtgtcttatgatatggacggcgtcaactttttgtgggtttaacttgtaaactttttgctagaatgctttttcaacttacaactgatgtgtgataccgtattgccagccgcgatgtttcccactagcgagttctacaaacgctgcttgcgccgcttgtgagtatttcgtggctgctgatttaaactgaatcttaatacgatcatcaacgcgaatatcaatctttgtttggtgacgttccttggcttcggcttctaaccgctcaaaaacgtttccgcccttaagcacgtatacccgcgtctgtgataaattgtctgtgccagtttgtgaccagcccattggccgcgaactgaagcgctctgaaagcatatgactaatatgaccttcagctgatgtcccgtgaaagtctggatcattgttggcctgaatttgtttccaattcttgtgaatgagcgttcgtgcttgtcggacagctttgcgttctgacgaccgtaactgagggtcattgagccgaacacggaaataatcatttagatagcttgagtgcccttgtaacgcccaatgcatgagaatatcgcccagattaccgggtacgccaattgccgcttgtttgcacgctttacgtaggtgaaatttatcgtagaccaccgtgcagttgggtagaaaatcggccccggttttgatccaactggcaccatcaccggccagaaaaaagcgtttgggcatctgaccgccatattgtttcatgatgcaatcaagcgtggtttgccagatttcttcagtaccagctgttcccgggtattcaccggtaatataaaatggcctaatcaactgaaacttcttacccacagaccgataaccttcatgtacataaaccattttcaagaaatgattggtgccgtcctgatgggggacatgatcttcatcggcttcgacaaataatgtttccggtacgggcattggttgatcctttaactgatccaaagcgctgatggccttcccgtctctatgaacaacatgcatgacggtgctcttcgatggttttgtacccccgccgttacgatctcctgattgcttgtaagacatttgggcggcatcttccagcagcttagctttgaggtcgagcgaaagtcggctacgcttctcaataccaacgagttcatcaagcaagaagacacgctcgccagtccgtttatcttgataataacgtcgggtgaaaaccagtgagccaatggatgccaagtaagtgcgttcccgcttatctttgacgctatagaatcgacggcggtaagcactgtccataatagcttggtccacttgttccagtgcctgcccaactaactggcagaggtgctcacgaaagttttcctgattggttaaaatgaattgacttaaatccagcttgcccgcgaccatctccatgacagattcatcaatttctttcaacatttctaaaatgatttgttgtactataggtgacaagagcgaattcctcctactgctatcgtgtttttcttgcaattaacattctagcacgaagggattcgctccctttttgtttgctcagatatcacccacttaaactttacgccatgtatgatatgcttgattcacagtaacagcttaaaaataagctggaattaattttaatttagaagttggtgagggcatgtgcgacaagtctggtcgaaaaagtatccgttaatactgagttttctattaccggggctattggtggctttttactttgccattcgtggtgcttttccatttgggtccagtagcgtcttaaccgttgatctcggccagcaatacattgatttctttgcctacttgcgccaaaccttattaggcaatcccggacaacttttttacgccttcaataaagggctaggcggtgatatgttcggggtttttgcctattatttattgagtcccttcaacctgttagttgtgctgtttcctgccgacctgctggatgtcgccgtttttgtcatcatgatcttgaaaatcagtacggcgggcttgacgatggggtggtatgccaaacgtcatgcgattacgggtttaatgatccccacatttgggctggcttatgctttaagcggctggatgttggccaatagttttaatttgatgtggcttgatgccgccattttgttgccgttaatcatccaaagtctggagacgctgctcaacggcgggcgcgtttttgcttatatcggttggttaacggcggctttcattgtcaacttctacacagggtatatgatcgccattttcctggtgctttataccggttactggctgggcagtcatgccgtttcttggcggcagacagcacatgcaggtctgcgctttgcctgggctagcatcttggccggtatgaacagcgcagtcgtgttgctgcctacctggtttcaactcgcccaatccaaaggcacctataccgtcaaaaccatccaatggcggttcgaatacgcgccggatcgactgcttagcaaaatgctgcccggaagcttcaattttgatcagatgccttcaggataccctaatttttatatcggtgctttaggctttgttttagccattcttttctttatatcacgacaccagacatggcgccaaaaaatggctgctgctttggtgaccgctttcttagtgctttcgtgcatgtttgagccgcttgacttaatgtggcatggctttcaattcccggtttggtacccgtatcgctttacgtttatcttatgcttttggttactcagtctcggcatcagcaccctgcagaagcatcaatcggcgctttcatttcggacgctagttattttattaatcgtattcgggctcatagatggggatgttgcgcttcaccttaaccattacaactttctaaccatcggccacctgatctttggcattggcaccttgttgctcgtcttggtctggctaagcctggatcaccgccgtccgttttggttcggttttgccattgtgttggtcgatatgagtggcagtttaattttaacgctaaatcaattggcgtatcttgatcatcatgcttaccatgattacgccgcggcccttatccaaggcgcacgcaccatcaatcaaacagataacggcttttttcgtattggcaaaacaacgattcgcacccgtaacgatccgatgacaggcaattaccgcggcgccgatcaattcaactcgctacttgagccggccacacctcaattcttcggccaaatcgggcaaccggaagacgatggctcggtcgcatacactaacgggacattgattaccgacagcttgcttggcattaaatattttttaacgccgactcatacttgcgctgccttacctgatgccggacaacgacctgatttaaagtggtatcaacagctgcgacaagtcggtccgtggcaggtgctaaaatccccatttgcccaacaactgggttttgcggcggacaaagcgttattaaatcagcagctttacagcgacaccccgcttgccaaccaatcctttattttgcaagcagcactgggtaaaaacacaacgccttattttactgctttgccacttccttcaccgactttaaccggcgtccgccgcgtcaccacgggtacaaacccaacttttgccaaaagcggttccggtccgcacacggtgacatatcaatttcaaccgcaaactggcaaaacctatgtactcaccctcggaagtcattttgccaatcatttggttaccttgaaacaaaatgggaaaacggtcacgttaccagaaagttttaatgataccatcaccgttaacgtcacccccgcaaacgcggcagaaattcagacgttaacttttcaactcaacaaaaaagaagcctggtttgaaaatatcggtctgtatcaagcgcatacggagcagctgatccaggaccttacgcaactgcaaacaggcggctggcacgtaacccatgtgactgccaccacacttgccgccaatatcaccattcacaagcaaaaccagatgttgcaaaccactattcccactgcacctggctggcaagtcaaggtcaacggacaaccggtgaaacccaaaaccagtttaggtattttcatggcgcttccgttaaaacccggccattaccacattaccatgcgctatcgaccacccttgttaggctggggcagcttgatcaccatcgccggtgtactgctgacgttttgctggtggctcgtgacatctcgcaaaaaaagaacgggaattattgaagcaaaacgccgcaccataattggaaaataaagtgtccgcgagttggtaggtaccaacttataattaaaagtccgccaccagtgaaacaacgacaattcgctggcagcggactttattattcttctttaaattcgtacttaggctcgtcaagatgtgcatcatagtcaaccgtcatgaccagattctcaaaaaaccacgcatctgtcgggttaacgaaataagtcacgccatcttttttaaccgccataattggctggtcagggtggtcatcgcgcgtcatgcccacgctaaaaccatcatgcacctgggttttaccataagccttgccaaagaatcgaatgccggcaccttcagcaggcaaatctaattcgcggtgaaaccattgactagctttatcagtgatcgcgagttgcaaccccatcatctccttgatcattttttaccagaccatgcttaagcgcgtaaatcgctgcttgcgtccggtcttcgacatccaatttggccaatatgtttgagacatgcgttttaacggttttcaatgtaataaagagctcggtcgcaatttcctgattcgacttgccttgtgcaataagctgtaatacctcacgttcgcggttcgtcagctcgtcatattgcgactgcggatgattcatccgattcatcatcttcgtggtgacttgcggctcaagtacccgttccccgctggcagtctggcggatagccttggcaatttcttcggccgttgcggttttcaaaatataactggccgcgccggcttccatggcaggatagactttggcatcatcgataaaacttgtcaaaatgatgatacgagcttgcggccatgcttttagaatttcttttgtcgcttcaatgccatctttaaccggcatcaccaaatccatcaaaataatatccgggcgatctttcagggccatttcgaccccttcttgaccattctcggcttgatcaacgacttctaaatcgggttggacgccaatataggtggacagccccagtcgaaccatttcgtgatcatcaacgatcaatactttaatcatgcgcaacatcctttgataacggtactctgacttcaacactggttccttggccgaccacgctaacgacctttgccgtaccacccatggctgccgcgcgttctttaatattggccagtccataattgccattactactggtttcttttggatcaaacccgacaccatcatcaaccatacgcaaaataaccatatcttgcaaccgcttcagatagacttcaagactatcagcttttgcatgccgcaacgtattgcttaatagttcctgaacaatgcgaaaaagattatcctccgcagctgcattcaactgaatatcgtccagttgccaagtgattttgatggtgatcttagtttgtaattccttcagcaactggataatgccttgcttaagtgactttccttcaagattcgtcggacgcaaatgcagcaataaggcgcgcatctctgcctgggcctcattaattactttttgaatcgtatccagttgcttattcaaagcttcttgtttgggatcgcgggccgccacactgcgcaacgccgacagcatcatcatggcagcaaagagttgctgggaaacagaatcgtgtaattcacgcgctaatcggtggcgttcgccggttaaaatggcttcccgcgtctcgccggaaaatcgcaccggtgtgttactataacgttcgatttcacgttgcaagcgtatcattttttgccgtaatgcttcaagcaaggcagccggttgttttcccaatgcggcttcagcctgttgcgatcgattaaaaatcggtgcctgatactgtccagcgtttaattgggctaaacgactatccaactgactacgcacgacccgctggcgccaaagcacaatcaccgtggcaccagaactaatcaataacgcgccaatgagcaaataaaccagcagtggcgccgacaatacattggctaataaaaggcgtagaaaatcgtgctgagtaacttttgccagcataaaaaccaaacaggcctcgactagaagtgtccagaccagcaagatcataaaaaaaccgactaacattcgtcgcctcataccgccagcacctccaagtcacctaccactacattcgtaatgatatggatacgccgtggtgcatcgtcataatcctgcgaatacatcgttacgctttgactatgcagcatcgagtccgcattttcaaaatggagccgcccgtaaaatgtcgcatgttcaaccgcgacgccaacgccaatgggaaccagaattctggttttgccaaagcctttgcgaatcataataacactgtcgcctttaggcaggaaagtatcccccaaatcaataatggtatcgccagcaggaacgaccatattgatgtcatcccagtcgtaactcggcgcaatggtttgccggttgccccatgaatgaaccgtgcgccgacccgcttttttcccaggctcctgcgtgaccggtgcaacgtattgtttgcggtcccacattgaaaaacccatccccggcttggttaacaccatgattaggaacacgcctgctaccatgagaatcaaccagactgccggattaataaagattcccagtaccaacaggataccaccaaatgtcacattgaacgcacgcattcgatgccaacgcgcacctaaaaagagaaaaagaacgccaaacaggatcgttgtcaacgccattggattggtgatgatctgaaaccccagccagaggatcaacgcaaattcaattcctaaaaacagttgccagcggcgcattgcgatccctccttatctaaaaatcgttgtgaacttagagcacactatccgaaaaagcctgctactattcacgaattattataacgaatcggaacgcaactcgcttagggcgtaaggctgatattcattggaaactggcgggactgagacatagttctatctcaggatgtgatgctcactaaaatccgaatactacagctgagaaagtagctaaagtagttccgggccgtgccaaactacgcaatctccggccagatggggtggcgacgcgaagctagagcggagacggcgcttggagcctgcaagcccggcagtctccaagtcgcctaacaacatcagcgacaaagcccggtcgctgtgttgttccacggctgagccccatctagcctacgattgctccgctttggcactgggatcgttaaagctcattcatacaaatatgaagaagccaaaaagcgtatcatttcttacaaaatcgagaaatttctcaatcttagtgagaaatggtacgcctcaattttgaagctgtgaattatgaccctgctccattattcgcgagtaagaacaaaaaacggcaatcactgctcttgcatttgagcgtgattgccgcttttgccttacttacaaaattgaagcctacaagtccgtcaaaaactcgcttacccttcaaccttggtaattttaacggtcatttcaccaccgggcgtgttaatggtgacttgatcgccaactttacgcccgatcagtccttgagcgatcgggctttcgttgctgattttgccgttgaaggcgtctgcttctgccgcaccgacaatttcataagtttcctcatcgccgtcttcttcaaaggtgacttttttaccgattgacacttcatttttagcgactgccttagcgtcaataatttcggcatagcgcaacatcgtttgaatcgtaacaatccgattctcaagggttgattgctcatccttggctgcttcatattcggagttttcggataaatcgccaaaaccacgcgcgactttgatgcgttcaatcacttctggccgcttcttggtttttaattcctctaattcgttttcaagtttcttcttaccttctgctgtcatcggatagcttttgtctgccataaaatacttacctcacttcttattttccttagtcactttattaagccagcaaccatttgtcaatggctactcttctaaaccgcgctctgccaaaatacttttgatctttgtgaccagcaaatcgatggcgacctgattctgaccgccttctgggacaatcagatctgcataacgtttcgttggttcaacaaactgatgatacattggcttcacggtttttaaatattgattaataatggattccagcgtgcgaccgcgtgacaccatatcccggcgaatacgtcgaatcacccgaatatcgtcatctgtatccacaaacactttaatgtccatcatgttgcgcagcgcttcgtcatcaagaatcaagataccttcgagaatgatcacgtcttttggctcaaggtgaaccgttttattcgaccgattatgaatcttgtaatcatacaccggctgatcaacggcatgtcgatgaatgagttgctccagatgatgtttaagtagcggcgtgtcaaatgccaacgggtggtcgtaattgatcttcttccgctctgaaaacggtttgtcacttttcttataatacgcatcctgtgccagcaagagcaaggaatgaccggaaaaatgattaaaaatagcccgactgacactggttttgccactggctgagccacctgtcacaccaatcacaataggtttcttctgttgcattttagccttcctcactcagtatataagatctgcgcataacacagccttggaaataacgtccgctggttggacactgcttccaaggccgcttaacctgaaatttgatttagcttccggacatgattttatcatatccaaaattagctgcatgctgcgctgtcaggacgtcacgttgttgattggattggtggacgaccgcggtgccttcatcaacggttgcgcttatttatcggcagcggcattatcgcttgcaaacttagctgtattagcatcatgttgctcgcgagtcgttgcatacagcacttcacccgtcttcagatttgcaacaaagtacagataatccttactgcgggcattcggactgagaacagcagcaatgctttgttcgctcggtgaatcaaatggtccggggccataaccggtgtgcacatataggttgtacggtgaatcaacgctggtgtctttgttggttaaatgtgtcttatgcgtattcaaggcatacatgacagagatatcggactgcagtggcataccggcatcaatccggttcaagaagacgcccgcaatggtacggcgatcttcttgggtcaccccttcacgctcaaccaacgaggccaaggtcatcacttcctgaacagaataaccttgtttcttaacgctcttgtaataactttgcatcacgctatcagtctttgccaccattgcctcaaccagatccttggtggtttcaccggcgctcacgctataagtggctgggaaaagatacccttccagacgataccgtacccctttagccgaggctgcagcgctaagtaacttaggatatttcttagccagctggttgaaaaaggtttggtccttcatcaaggccaggaattttttgctcgtcagattttgattggatttagccaatttattaacggaagtcgcaatttgctcaaccgttgcgccttcttttaccagcaactgtcccgccgcggctgctgaagtgccacctgcacgcaacttttgaatcacctgatccatattgtcacgttgcgttagttgatagcgtcctgcttgaaaatcggcaatattgtgaaacttcacgtaatagttgaacaccatggcacttttaatcacatgcttggcttctaatctgctcgcaatttgtttcgtgctagagccagccgggaccgtcacattaatgcttgttttgccattagggttaactggctgtaaggctgaattgacataccggtagcccatcagtccaacaatcacaagtacagcaaataaaataccgagaacccaaccgacgattttttgcgatgcttttttctcatgttgccgctggcgtcgtttacccgccacgtccggggatcgcttgtccaaaaagatgcctcctttttctcatgccaacgttaacctcatccgttatgcttgcacacaaataaccgccaagcataacagacaaagttatgacaacgccattatgtagcaacgtcaccgtcagatcatgcttgacggtgacgcgatacagtctgaatgttactgagtccattgaccgttgccagtgactatcataccgaaccaccggctaaaatgcgactaacgattaacgaatgattgcccctaaatcagattcaagtgctgctttgacccgatcaaaagcctgcgtaacttcttcttcggttaaggtttggtcatcgcgccgataagtgagcgtataggccagactcttttggcccggcgccatatgcgaacctgcataaacatcaaataaggtaacgtctttgagatatgcgccaccgtgttgctggaagatctgcatcacttcggcattggtaacggtatcggcaacttgcagcgcaatatcgcgcgtcacagccgggaacttcggtgcaggctgggcaatcttctcctgacgcggcgccgcaaataaggcatcaaggtcgagctcaaagacaaaggttgcgggtagatgctgttcatgttcaaacgccgggtgcaaacggcccaagaagccgactcgctgcgtcccgaccaaaatatcagccgcctgacccggatgcagttcactcaccgcctgagtcgctgcaaagtgcaccggttcagccaatgaataatccgccaacaaatgcgtcacaatgcctttgacatagaagaaatcaacgctgcgtgcggcttgatgccaatttttggcggctacgtggccagtgatagcaccgcctaaatactcgatttcagttggccgtacctgatcaccggttttggtaaagatccgtccctgttcgtaaatggcaacatctgtttctttacgggcctgattatatttaatgacatctaatagacctgtcaccatattcattcgtagtacggcatggtctttggtcatcggtgaatcaacctgcgtcggctcgccgggttgcaacttaaacctagttgccgcttgctcagtcgtcaggccataagtaatcgcttgattaagacccaacccttcaaggagatggcgggtacggcgaattcgcttttgcgccggtgtatactcgccaatcgtcatcgtagtagtcggaagtgtacttggtaaattgtcaaagccataaatacgggcgacttcttcaaccaaatccgctttgatatgaatatcccaacgccgaggtggaatcgcaaccgcaaataaaccatcagcaacttcaacgccaaaacctagttgttggaaaattcgtgtcacctggtcttggcttaatgtcgtgcccaacacgtgattaatatgatccagcgaaatatcaaccacgacatcttttgcgtcaaccgcagtcggacttacggttcccttggcagcctgtccgccacccaagtcgctcatccaggcaactgctgcatctaaagcgcgattaatatcagctaagttaatccctttttcaaaccgcgatgatgcctctgagcgcaaattgtacttcagcgctgttttacgaacgttaaccggattaaaactggcagcctcaacgacaaccgtggtcgtggtttccgagatctctgaatccaagccgcccatcacgccagctaacgcaactggcacctgaccatttgtaatcacgatatcgctgtcatctagttcgtgttcgccaccatccagtgtggtcaacggttccccattgcgcgcccgccgaacctcaatgtgctgactaccgagtttagcatagtcaaacgcatgcaacggctgaccatatgccaacatgatgaaattagtgatatccacgatgttgttaatcggacgcacgccagcattccataaccgccgttgcaaccaaagcgggctctctttaatggtgacgtggtcaatcacccgtaactgataactcggggcatcctgagcgtctttaacttcggcactgagataatccgctaccggacgatcaccttctgtcagcggcttttcttcaaagtgcggcttttcatcataagtcgcgcccacttcccaagcaacgccgcgcatgcctaaagcatcggcacgatttggcgtaatctcaaaatccaacaccgcatcatgcatgccaagtgcggctaaagcatcagtaccaggttttaaaggttcattgaaaacgtaaataccatttaaatacgctttgggaaccacattttcattaaaaccgatttcttgcaaagcgcaaatcatcccaaggctttcttcgccacgcattttgccttttttgattttgacgttatcggcaatccgtgctcccggaagcgcaacgatcaccgtttggccagccgcaacattgggagcaccgcaaacaatctggcgcggttcgtcttcacccacatctacctgacaaaggttgaggtgatcagagtttggatgaggtttgatcgccaataccttaccaacgacaatctttttcaatccggcatcgggatgtttaacatcgtccacttcaattccggttcgtgacactttatcggccaattcttccggtgataccgggatgttgacaagctcttttaaccaatcatatgaaacgtccatcttaaccctcctgactgaactgcgtaaggaagcgcaagtcgtctgtgtaaaaactgcgaatatcgtcaatgccgtatttcagcatggcaaaccgatccgggccaagaccaaatgcaaacccgccatatacatcggcgtcaatattagccgcacgtaaaacattcggatgcaccatgccggcaccgagaacttcaatccagccggtatacttgcaaacagggcagcccttgccaccgcagcggaagcaggaaacgtccacttctacagacggttctgtaaacggaaaatagctcgggcgcaggcgaatcgtccgatcagcgccaaacacatgctgacacatggcgagtaacgtccccttaagatcagccattgtaatatgcttgtcgatcaccaggccttccatctgatggaactggtggctatgtgtggcatcatcatcatcacgccgataaaccacgcctggactgatcattttcagcgggcccttagtaaagtcatgtttctccatcgtccgcgcctgcatcgggctggtttgggaccgcatcagcaactcattggtaatataaaaagtttcctgcatatcccgcgccggatggtccttggggatgttcatcatttcaaagttgtaatgatcctcttccacttccggaccggttagcacttgatagcccatgcccataaagaagctttcaaggtcatccataatctgaataataatatgtggtgtgcccgccgttaccggatcgcctggtaatgtgacgtccacggtttcagacttcaatttttcgttgatgactgcctgctccagttgagatttacgcgtctcaatcaccgtactcagttcatcccggactttattggcaaaggcaccgacttttggccgttcatctgctgataaatccttcatgccgcgcaaaacgctggtgatggggccttttttccccaacaactggacgcgaatctgatttaattcgtccaacgaggtgatcttttttatcacctcattattttgctgaaaaagttgttcaagtttcgtttgaagatccatgttcttcctccttgactgctaacctgagaagtccgccgttgatacgtttgaaggcataaaaaaagtcccttctcaaaaaagggacgaagcatcgcggtaccacccttgttcatgattaaaaaacctcatgcactcaacaaggtaacggccaggccggagctttctaagtgttgccacctcaaaagtcaactcagaaagtgaagacaaacattttggtaacagacgtcttgcagtctcgtgaacgtcattccctgatttaccagcctgtttgggctttcgtcattgtttttacatttttttgataagacaagcttagcaaattcagcgcagacgtcaagagctgatggctaatagttgggtaattaggctctttttacttagggtctctcacatgtgttctggccaatgatcaacaatggcataagaaaaaaacgcgtcttttacgcgtttttttgcttttcattggcatggcactcttcatcggtaacccatgcgtcaccccaagcgtgtgcagcggccatgactgaattcaaagcccggcctttatctgtcagggcgtattcaattaaagccgagtccttgtgcgtcagacgatcaatcaagccctcgccttcaagttccttcaagcgttcgaccaaaacccgatccgaacaccggggaatcagttgcgcaatatctttaaaccgagaattgccattgtttaacaaaacttccagaatcaaaccgttccacttcttacccaaaatttcaaatgtgtgctgaaacttaggacaaagagcgacttgttgactttgacattcggttttactggttactgttgcatccactctactcacctcatcatacccgcttacttacatttagatagtgttagcataacacactcccaaaatattacaagtcatgcttatcatcaacaactcaaaagctaattgatgcgtctaaaataaacgaaaaaaactcacaatacgtttcaaagcgtggcactgcatccaaagctgaattttgctctcacaatttaatatcggctcgtgggggaaaatatacccgtcaaaaaagagccgcgggacaccgcccacgactctaatatgacgacaataacagtgcactgccgtcaatcacgatcctaatttaaagcttttaagtgagtgtgaatcggatgccggagcttgtgcatccagggtacaacgacctcatccatcgcagcataatcatcaactagagaaacaacaaaactttccttatacttcggcaagccaactgttgcaccccacatgtgcttgatgataatgtctttttccatcggtgacaattcggttaacttctcagcattccgtaaagcaatccgaggatggataaaggcatgcgtccccaagtcgaacttggttttgcgccaatcatagtaaaacagatcgtgcaacaagccggctcgggcgatcgcacgaacattcagatgcaggcgcttcccaatcaaataactctgataggaaacactaattgaatgttccaatcggttcgaataatggtgttgcgggtgttctgccagtcgctggacctcgggcttagccaataaatcagccacatacccaacgtactcagcatccgattgccaatcgcgttttttgctcaagacatctgctccttttgtggtttgatgaacacacccatagtataacagcttcccaccctaaaaagcacgttcgtaacacattcttaatcaccgactaagtgaaacatcatgatggccgctgcgacagcgacattcaaagattctgcttgtccccgaatcggaatatacaggttcgtatcggtttgctttaaaagaacaggatccatgccattgccttcattgccgacaacgagcccgaactgtgcgctcggttgaatactgcgataacttttagctttatcattaagctccgagccataaacgggaatccctgcccgttgcaaggctttaataacgggcatcaattttgccgatacgatgcgaacatgaaactggctgccttgcatcgcgcgcaaaactttcgggccaaaagcgtcggctgttccattaccaaaaatgacggttttaatgcccgcagcatccgccgtccgcaccaaggttccaacatttccgggatcctgaatcgcatccaacagtaaaaactgcccacttaaaagatccggcaattgcccggcctgacgcggcataaccgcaaaaattccctgtggcgtttcggtgtcactaagatgctcggaaaccgactccgaaatctgcgtaattttgtcataaaacggcttaagcgcacgatcatcaacatacttttcggtagcataaatatcataaggcgtctgcccactcgccagcgcctcttgaaccaagtgccgcccttctagcaagtagcgcccagcatccttttgatgtttcttaaccgttaatttcttggccgttttaatgcggtcattttttggtgatgaaatatattccataaaaatctccttttaaaaagtgagcgcgatccggcgcggttagggatcggagtgtaagcggccttgggcgtgatggccggtctttggccattgcgaccaaggtccttacacgtagatccctgcgccggggagcgcgttatagaaagtgagcgtgagccagcccggttagaaaccggagcataagcggcctcaggcgtgatgacccgggtttggtcattgcgtccagggtccttatgtgcaggtttctgggctggcgagcgcgttaatgtgagcgtgagccagcgccaatcaatctcagccgcaccatccacaaacaaaaatccgacttttgcctcttgtcgcgttttctatataccttatgctacactagtatggactgtggagaaagcaaagatgaagatgttttcatcacctttcgatccaaatcttctacacgaaaggaagtgtctttttggtcaaactcgctaaacaaatcgtcgttcggggacgggttcaaggcgttggttttcgctgggccacgaagatgattgcggataatctcaatatctgtggcaccatcgaaaatcgcgctgacggctcggttttcattcaagcagccggtgaaccgctcaatctagccaaattcattgcacaggtcaaagccggtccgaatccttacgctaacgtgtcgacttttgaagaaaagccgctggaaaatgtgcccgacttcaacggttttcgtgtaaccggttgaatccgcttggtccatacagtatagttaaacccgatgacattttgaagggaaattattcatgcacaagtcgaaaaaaatatttgcactaggagcggtaggcattctgccgctattattatcagcgtgttcgccaacgaaacaaggcgtcacactcaagccgccgacagatccatttttcggtactttctataagataatcgggttgccgttgcagcatttgatggaatggattgccggattcgttgggtcgaccagcagttacgggattgccattatcgtcattaccttattggttcgcctaatcgtgttgccactcatgctgcgccaacaacgaaccatgacggcttatcaggaaaagcagaagattctccaaccgcaattaaaaattgtccaggatgccgttaagcgcgcaaaaacaccagaacaacaaatggctgcgaataattacatgcggaaaatttattctgctaatggcaccagcatgatcccgtcaatgggttgcctgccaatgctcattcaatttccgattttctcaggtttatatcaagccattgcgtattcgcctgagatttcacacgcaactttctttggcattcagctgggacattctagctttattgtcaccattttggccacgctgccatacattattgtcagcctgatcatgcttcaaggtgtcccgccggagcagcgaaaggcaatgcaggcaacggctttcctgagcccgatcatgacatttgtgttctgtatgatgtacaacgctggcttgggtttgtattttggtgccggtgggattattctgatcatccagcaagccatcgtcacttacattgtaactcccaacatccggaaacggcttgatgccgaaatggaagaaaatccgcctgttgaagttgttaatgaacatacctttgatgactggggtgccgtcacggccactgccggatcgaccggaacccaaagccgccagcaaccagtagacccagatgccattgatcatcaacaattacgcaaacgaaacgccggcaaacaacaacggccacgtaagtaaattaccaacacattgaagtcgtctttattaggcggcttttttgattgtcgaaatctaaatttgccataaaagcaaaaatggtgtacacctgtctgctcacaactggtaaagtctcctactggcagcgcaaaaatatggccacacgccaaaaaccggtttcagagttaacaagaatgctcacactccgaaaccggttcatttattgattgtgttccgactacaaattgcttttaattaacgtatcacttttcggcgcagcagcctgctttgctgcttcttggcgttgaagtgctttggctttgtccgccgaaatcgttggcaaatcaatccggaagatcgacccatgacctaaagcggagtctacttcaatttgaccatgatagctttcgatcagttgctgagcgatggatagccccagcccattgccgcctttttcccgactgcgagccttatcaacgcgataaaagcgattgaacacgcgacgccgatccttttcggcaataccttcaccaaagtcttgaacggcaactgcaatcccattgccactgttttgcgccattgagacatgaatttccttgcgatcagtcgaatacttgacggcgttatcgaggaggataatcatcacttgctccagatgattgcggtacatgcggacaaaagtcgtctgctctaagtcatcgtctagcgtgaacgtaaactccggatgaatcatgcgaaaatcggcaacgacctgctggacgactttatggacatccacaaccgcattggggaactgaacatccacctgatccgcgcgcgtcagatccagcatttcctgaatcaggctcttcatccgggtgatttcttgaagtgaagcagccagcgactcgttaagcacttccggatcatccttaccccaacgattgagcaattgtaaatgcccttccaaaatagctaccggagttcgtaactcatgcgaaacatcctgtacaaattcaccttgctgatcaatgtaacgttgaatccgatccagcataccgttaaattccagcaccaaatcgccaagttcgtcattgcgcttcaatgccggaattcgaaccgtgctttgcggctcctcattgacaacatcaatggcattggtaatcagcttaatcggacttaagaatcgggttgccagtacatagccaatcagaattgaaatgagaatagcagcaaaactcaaaccaataattagcaaggtaatttcatgcatggtcgcatgaaacgctgtcagtttgttcgtcacctgaacgtaaccaatcaaatttgaactttcagccgaataaatgggtgcagttccgaccagtccgttaaaatcaccgatatgactttcctgaacttcaaatccatgaaccttacccaacgtgatcggggtgtcacgcgactgaaaaattgtcgtccgatcacgcgaaaacaccgacacgctaacgtctgcctgagccaatttctgaataacggaatcggaaaaaatccgcgtgtgtgactcgctgggagtaggcagtgacgactgatcggacggcgttgtcccttccaatcgcggaactacctgggccatggtcaaatcgccaccgaccggggaaagccgttggacgactgtgttaagggtatcggtgacggttcgacgctcctgattaatcagaatctgccgcatcgcaccataaaggatcattgaaaaagtaacaaaagtgacaaaaatcccgacaccaactgtgacggcccatttgaccttcagtgagatgcggggattcttcttttgcttagtactggtttgcttgatatgcattatgaccgcataacatagccggttccccgaaccgtctgaatataactaggttcaccgggccgatcaattttatttcgaatgtagcggacataaacatcaacgacattcgtttcaacatcggaattataaccccagactttagacagcaaaacatcacgtgctagaacaacgttgacattttccattaaagtcaaaagtaattcgtattcacgcttggtcagttcaatgatgtcatcgccacgccgcacaacgcggttttccttttcgatgacaagatcgcggtacttgatggtcgtttgcttggcagtgttgttttcgccttcaatactaattcgacgtagtaaggcgcgtaaccgtgccagcagctcctcgatggcaaacggcttaacaatatagtcatctgccccatgatctaagccgctgacccgatcaatcaccgaatcgcgcgccgtcatcatgataatcggggtattcttcacctgacgaacacgccggcagacttccaatccgttcagttccggcagcatgaggtccagcaagatagcatcccaatcttctgctagggctgcttccaaaccggtacggccattaaaatgaacttcggtttcgtaaccttcatgctttagttcaagttccacaaagcgggcaagattcttttcgtcttcaataattaatattttactcattagcgtctccttatactttcggtgcatgaacacacaatctgaatctatttttagtttctcataaaaacatacgctaggatagtttagcacagttttctcattttgactatcagccccgcgctaataggcatcaaagctaatggaaaagcctaataatcaaggctctcatttttcaattcggctaattctcataataacctgcgatactttctaatctgtctttacgaaacatataccattttttaagtctgattgtcaaagcctttgtgacaatgatacattaaaaaaaccaattcagatgcgacacttaatcgcaggtgaattggtttagacttaaacttcaatgaattaagcttcgtcgtaccaggtgtaatggaaaatgccatcacgatcagtacgttcatatgtgtgggcaccaaagtagtcgcgttgagcctgagtcaggttggccggcagaacaggggcgcgataagagtcgtagtaactgatcgccgctgagaagcccggcaccggaacaccggctttaactgccaagccgaccaagtcacgaacactttcctgatagttcttagcaatattcaggaagtaatcgtctaacaacaagttctgtaaatctggcttcttatcgtaggcatcggtgatattttgcaagaaacgtgcgcgaatgatgcaacctgcacgccaaatcttggccaattcaccgtactgcaggttccagtcgtagttatccgatgcaacgcgcatttgttcaaagccttgagcataggacatcagcttgctgaagtataacgccttacgaatcatctcgatagcttcttttttgtcaatcgtgacatttccgaccggctttggcagaactttacttgccgcaacccgctcctgcttcatcgcactaatgtaacgcgcatagacggattcggtaatcacactttgcggaacacctagctcaagagcagattgtgaagaccatttgccggtccctttgttgccagcgcggtccaaaatcacatcaacgatcggcttgtcactaccaagatcgtctttacgagtcagaatatctgccgtgatatcgatgaggtaggaatccagttcgcctttattccagtcactgaaaataccggcgatttcttctacgtccaaaccaagcaaatgacgcatcaagttgtaactttcagcaattaattccatatcgccgtattcgatgccgttatgaaccattttgacataatggccggcaccgtttggcccaatgtaagtcacacaaggtgcaccgtcatccgcttttgccgaaatagcctccagaatcggtgctaccaagtcataagcctctttttggccgcctggcattaaggatggtccgtgtagtgcgccaagttcgccaccggaaacgcccataccaatgaaattgatcccggatttatccagttcggcactgcgccgcatagtgtcttcaaagaaggtgttcccgccatcaatcaaaacgtcacctttatctaacagcggcaataattctttaatcacggcatcggtaccggcaccggctttaaccatcatgataatccggcgcggcttctctaatgaagcaacaaagtcctcgattttatagctcgggaccaatttcttgtccggatgttcttctacaaccgccttggttttacttccggtacgattgtagattgcaacggtattgccgcggctttcgatattcaaggcaagattcttacccataaccgccatgccgacaacaccaatttgtggtttatccattaacatggacctcctcattcattcatcatttactcttttcatgttagcagaaaccgcttgggtttaacagtcaacagccgagctagaggcctgtaaattttctttgattattttttgttaattctgcaaccgtcacgaacagagcgccgcacccaaaagtttcacagtcaatcagtcagtttgatcaggtaaccgctttcttaatgagctatacttgttataaaaaggagttccattatgaaagcccccacacaaccaattgttgttcactttccattacgcggcgaatggttggcacccaatacgcctgggtctaaggttccaagccatggttctaacaaattcgggacgcgttatgcgtatgattttattcaggtcaactggcagaaacttggtcgtcctgcctaccgcggtagtttgttgaagtatctattccgcggcattccgattgacgactattattgttatggccagccgatttatgcgccagccaacggtttggttgtccgcgcagaggatcattatcctgaacggaagcggaccagctttttaggcgacttacttcgggcaagaaacgctgcccggcattttgacccaaaaagaaacaacgttcaggcagttgccggaaactttgttatcttacaaatacacgatcatgtttacgccgccttgtgtcatcttcaaacagactctattcaggttgggcgcggacaaacggtccaggcaggtgatttgcttgggcgcgtgggacattccggcaactcatttggcccgcaccttcattttcaactcatgaacaacagtgacattgaagttgcggctggccttccttgtgcatttgccgaatatgagcttttcgccggaaattcatggctaacccaagaaaacgctgttcccagcaaaacagaccgaatttgctttgtgtcacctaagtctggacctttttaaaagggtacgcttctttgtgggccgtgatgaccgtgaagctgtttgcgtcaactacccgtcgctaaagtatcgggcttgtgactcacgctgctcaaccggcagcagtagtgcaaatgcctaacggctcctacttatgtggtcacatctcagatcgtgtttcaacggtctcgggggcagacaactcccgcagatgcatagttttctctacccagtctgcttgtgcgcgtaacacggcttgacaatcccggccagccactggtttcccagttgctggatgttcatggcggctgactggtcgtcattggcatggaagccacagacacagacgtattcatggcgctcgtgatcccgctgctgtttcttgatcacgccacactgtggacagcgttggctggtataaccagcaggcactttcagcacgcggctgccttgcgcagcagctttgtatatcagaaactgttccaactggtaaaacggccaactgacctgttcatagcgtcggtcttgagcaacttttgcggttgcacaacgaacatcagtcagatcttccagcacaaacagggtatttgccccgcaacagtcggcgagtgccttagccgcacgatggttttcgtttgacatccagcggttctctcgctgacggattcgtttcaggacgcgttttgctgatttcgttcctttggcttgaagtttggcccgcaggtacttgtaccgctgccgcttgttgagcgctctggtccctgaccaataggtggtccggccggtctcgtcaaacgcggtggctaaaaaacgcagtcctcggtcaacccccacaacatgagtggtctggtcgcgggtataatctggcacttcttttgtcgcgctgatgtgcaaataccacttgccgccgctggtcaacactttggcggtgccgagtttccaagtaccgtcaaagtagtcgcgccagtggttcaataccggccaaacaatgaggcggccttctaatgtgttcagagaaaaggagccatctttgcggatggcccaatcccgccgtcggaccagatctagctgcggccgccgaaaactgattgggtgccacagccaagtcagatctttagcttgtctttgccactgaccagcttcgtcttgataccgatacggtctttgtttcaactgagtgtgcactgctcgatagcgagcgatcacagttcgcaggactgactgtgccatttgagctttcagtccaaacctagcccgcagcgagcgatacaggaccatttgcagtttcgtggtgttgagcacaaagtcatggtcaaacacatagcggctgacgttatcacaggccaagcggtactgatccatggtttgacgcagcaaagccgcatctgctttcgccaccagtttgaactgtattttaaccgtcttagtcagttccatacgagtgccaccttagtcgaatgtttgttcctatcagctgagcaaattatatcagagaaggcagggtcgaggcaattcctcctatgattgaaatcatgggtttccttgcctcatttatcatgaatgttgatcgtgatagccgcgatcttgacataccaatttttgccttttcgtttgatgattgcttgaagattcaaaattttcttcttgcaataatcaatgatttcgccatttatcagcgaaagattgtgtctgatgcggtcacgccctaatttggtagtgtgtaacttgtccaagtttttgattaactgatgagccgaatctatcatgacggtcaccacggcaagagccatttttagccctgcttccttcctcaactttttctcaaattgtgcgcgccaagatgggcactcaaaaaatggcaaccgcgcaagctgctaactgacgaggttgccattcttcaataaactcaactgctttgtcgttagtttccagcggccgattcatcagccttgatcgtcgttcgggaacatccccttcaatttcgtgaaggggttttctgcctgcttttctttcttaacggctttgtcaaaatcttcttcagccataacttcccagtcctcgcctgaaggcatctcgccactggcggcttcttctggcgttagcacttgcatggggatacttaataacaaatgatcctccactgccggcaacaaatccagctccggatcctcaagcggcatcagaatttcgccgtcttcatattgatcggcatggccatcatcggtcagatagatctcgctaaacgtgaaatcctgcggcagcgtgaccgggttcaaactgcgcgtcgagggaactaccaaagtaccctttaagttgacactaaccagaaaatcaccgcgatcataaacaatatcgccgcttacctggatgggactgacatcaagaacctctggatcacgatcctgcaaatctgccttgacatccaacgtggtactaaaatgcaacggttcctgatcgtgtttcattaattcctgaatcgtccatttcaacatgttattttgcctcctttagacgcgcacactaaccttaagatggagttatgagcgcgcttcacatcaacggtcggcggccataattttgttcaacgccgctaatcgtggtgattaatcgatccgcacgatgggtcatcgcaaggatcccattcggtgcaagcatatcagcactgacgcgagtgagcaagggccagccaacttggtgtttaacctggcgtaagtattgctgaccggctggcgtaaacccgagcacatgcagttgcggcaagtgccgagccttttccaccgccgctgttgtcatattcagcgtgattgctaaagctaatcgccgcagtctggcgtaagtgtatcgcttggacttgacccgctttaaaaagctcgtcatatcaatagcgtcatcaatctgctgggtgaaacgatattccagcccttccgccatcgtggcaacctgccgcaactgcgccaagtctgctgtctgcagacgatatttcaaccatgggaaatattgcggccacccatattgttgctgcttcgtataaaccggaatcagatctgcaggaacgatcttcgcgagcgattcacctccgcgcaaccgctgacgaatcgctgacgcactggccagattagctgtcaaatggagcgcatcatgggccacgccttgccgaccgaacggataaagctgcatcggcacttgcaacgccaaaaccgcttttgcataactcaaccccaacatgaaattcgggtctgtctgcgtgatgccggctgtttttgcataagcggcattaagctgggtcgcataagtctgggtataatccgaaaatcccggatccatcaaaggggctttttctaattgtcgggcaaggtccagataggcaagttcggggtgttcggttccaaatgccagtgcggtcacgcgtaacgccgctaacgtcgcaaccccggcttccgcaaattgatccgccgcttgcaccgctccggttaccggcagctcaatgacaatatcggcgccatgatccaacgccgcccgcgcccgcacccacttatcaaaaatcgcgggttcgccacgctggacatagtttcccgacatcaccacaaccacaacatcagcctgcgttaattttcgggcttgtgccagtgcatatgcgtgaccagcatgaaatggattaaactctgcaatcataccgaccgcttgcatagacgcctcctaataaatttgcttattcatttggctcatcacggctactttttgcgcgcgtggaaaaaccagcgcgtactttcaggtcccacaggctcgttgccaaaatcggcggtaacctcaattttttcgaacccggcattctgtaaggctcgcaaataatcagccaacggataagtgcgttccttgtgtgtttctgtcaaaggcttataggcatccaaggcttcatcgtacataaaaaaggtgaggtcatgctcaatgctatgcggttgctcgccaataaaactattccataagaacgcaaagtcatccgtttgatagttgtacatataacccggaaagacctgatccatttgataaagcgagtgagcatcaaaaagaaagtcgccaccagtcggcaaccgtgatgctacctgtgtaaagacctgttgcacctcatccagattctgcatatagcaaatcgaatcgtcaaaacaagtaacaattggaaattccggtagcgtttccagatcacgcatatcgccttgaagcagggttaatgcgacccctgcagcatcggctttttcctctgccaaggtcaacatttcttcagataaatcaaaatccgtaacttgatagcctgactgagccaatagcacggccaaaaagccggaaccgccagccaactcaagcaatggctgatgactcggcttcactcgcttgaccacataatcacgccaccgttgatacaatgactgatccatcaattggtcgtaaacttcggcaaaggtcgtgtagatcatgcctcaacccactgatccactttaaccagcggtgcatcttgccataacttttccagattgtagaattgtcgctcttctggcataaagacatgaaccaccacatcgtttaagtcaatcagcatccacttggaacctttttgtccttcaatccggcgaatctcaacgccggccgcttcttctttttcttcgatttcatcaacaattgcctgaacctgacgatccgaagtgccgctcatgataacaaaataatcggccaacagactcacaccgcgcatgtccaatgcaacaatgtcttcagctcgcttcgaatcaccggctttaacagcaatttccaacatggtttttgcgtcgatcataaattactcctttgataaaaatgcattgtaggttaacagtgttttcggataaaccaattgacgcgccccgatcagataggtcaaggtgttttcaagctcaatgcggctggcttcttccaagttagtttcggctgccttgcgtgctttggcctcaaccggcaatgaccgttggggttcaataaagtcaccgacaaacacacattcatccagcttggtcatttccggatcaccggttgtatgccgcgcaatagccgtcagcacttgtttatcggtaatgccgacttcggtttgaataaaatgaatgccaacaacgccatgccagacaccacgaccatactgcagtaacttgggatcaaagccatcttcgataatcacgcgtttatatgtttcaaccgagatttctttaccataatcatgcagtaagcccgccaagcctgctcgatccacatcttggtcaaagcgctttgccaattcgatagccgttgcttcaacccgcaaacaatgttcatagcgaggctgatcaagccgattgcgcaggcgattcagaatttcttttcgactcaagccatgcgttagacttgctggatattgatgttcattcacgatataatccctctttttgaatatagtcaatcactgggtcaggcaccaaatactttaagctgcgccccgcttgaacgcgatcccgcaccgctgtcgaactgatatcgatcagcggcgcgtcaacccataaaattggatagcggctagccggtgtatacccgcgccgcttaacgccgacgaaggtcactaattttaccagttcatcaatgtgcgcccactttggtaaatagtcaaccatgtcggcaccgatgataaagtagtaatccgtatccggatgaagtcggtgcaactcctgcatggtttgatacgtgtaactaatgcccccacgccgaatttcaatgccttccaacccaaaaagtggattatcggcaatcgctaattgtaccatattcacccggtgccgagcagaaatggccgttttggtatcgacatgcggcggcatattatcgggcatgaaataaactttctccaagcccaattcggtgcctgccgcttctgccataatcagatgaccgttatgaatcggattgaaggtcccaccgaacaaaccaacctgcttgcgacgatgcgttcccagaatctgttcgcgcatcgcaacagaaataaccggttgcgtcaacgtgacattctgcatctttttcatcacaactcctaccgcgcattgacttcaagactgatgcgacgatgttccggcttttctgcctgcttataaacgatcacggtgcgcccaataatctgcgccacttccaaaccggcaatcgctgcctgtaacgtatccgcaacttcttgcggtgtatcgtcagcagtcggtaatagactgatcttgactaattcacgggtttcgagggcatcctttacgccagcgacaaaagcatcgcctagcccatttttgccaacttgaattaacggtttggtcgtcattgccagactgcgtaaataacgtttttgtttaccagttaacatgtttttaacgctcctctgattcagttgtgccgcccttccaccacccacaccgtttttttggtcgctgcgggttggctgcggctcgtttagataaatgctttacgtaataaaacatccacgcctttaggggcataccctgcaatggtgacgccagccggtaccgtaatccagccaagaccggcaaaaaccaaatccgatttttctttcggcgtgaattcaaagcgaaccagcggcggaaaatctctgacttcatcagcttgtggcggcgctagaagacccccgacatgcctctgataaaactcatcagcgttgatcaattttgtccggtgcagcggcaattgcgtatcggcgtaaatgacaaagctttggcggccgccgcgaagataatcgaaccgtgcaagcccgccgagaaagattgtctggccttcattcagttgataagtcgccggtttaatcaccgaagtcggggataccagtttcaaatccttggggccgacaaaatgtgccatctggtggcgatgaatgatgcctggcgtgtcaattagcgactgcccatcatctagcggaatcataatgcgatcaagcgtggttcccgggaagcgcgatgttgtaatgagatcctcgacaccggttaattgcttaataatgcggttgattaacgtcgacttgccggtgttggtcaccccaacaacgtacacatcacgatgttcgcgatacttctcgatagcggtgagtaactcgtcaaccccaaacccctttttggcactggccagcaaggttgttaccggccgtaatccctgggctttagcttgctgctgcagccaattttttaatttattgggattcaacgacttaggcaagacatctgccttattcccgaccaaaatgacgggattatccccgacaaaacgatgcaatccgggaatcacgctgccgttaaaatcaaaaatatcaatgacattcacaatcaatgcattactttcaccgattgcattcaggaggcgtaaaaaatcatcgtcagttaacgtgacgggtgcaatctcattgtaatgccgcagtcgaaagcagcgttggcaataaatgtcatcgtcagcctcggcttttgctaatgtcgcggctggcagatagcctggctttttaggatcggttgtctgcaaaatagcgccacagcctatgcagcggcgctctgtttcatcattgatgatgtccatgaatatcctcctgataattcagttgccttttcttggctaaggctttaaacacaaatccctcaaaaaagcgattaatccgcgtgttccaggcgtcactttgcaccaacggctgagttaagatggtccgcacgccggcaagattaccggcccagatatctgtcagcagctgatcccctaccatgacaacttcagaacgcgtcagccctaattctttgcgcgctttggtaatcccgactggcaaaggttttaatgcccgggcaacataagccacttgcagctttgccatcgctttatggatacgattggcgttgttatttgacacaacaaccacctggatgccgccgttacgtaaatcagaaagccactgggtcagcttagccgtaccttctgggtgatcccatgccatcagcgtgttgtctagatcggtcaacaccgctttaataccttgctgctttagactagcaggcgtcaggctaaaaatattcgttaccagccaagtcggctcaaaaactgccacaaatcctgtcccctctccggttgttcatatccctatattataacggaaaagattggtcggcgcgagtcagactaagtaacagtaatgtcaactttttctcggttctactctaattaagtgatttccgatactccgagctggttccgcggtggcaccggctggcgaccgcgcagctagagtggtgggcacgacttcgaacccgcaaagaccgcggtttcgaagctcggccttggtctaaagcggagaagcccactccgcttaagaccaatttcaccactgagcccgccaccgctccgccagctcttgctttctatcctgatactcgaacaccttgaccatcatactgctgtaatcgcctaaactgatgcgctcgtgtttgatatccacatgctccaagagaaactttacactaactatgtaacaaccttcgcagtggcggtgccaaaaatgtaaacgttatctttaaaaggcgaaataatcgcgttatcagaataaacagggtaggatgaatttgatagcaaacgctcgcatttcgatattaagcctgttatacttatttttagtaagtgttataaagaaggaggctcatcatgactcgtttgcaccatgtgtcgttgctgactggcgatgctgccgcaacgatccgattctataccgatgttttgggattgcgattggtcaaaaataccgtcaatcaggaaaatattcatgtacggcacttatttttcggcgattatcaaggaacacccggtagtgtcgtgaccttcttttccattgatcgactggggcatcgttatgatgggccaaatcaattaggcgggattgatttggcgattcctactgagtcgttagcattttggcataagcggttgcaacaagcgggttgtgtggtgacgaaaacggctaacctgcttgcgttggttgaccccgcagatacaccgctacgactcatcccctaccaacggactttgccggatgcgctaacggttcccaatgatgttccgggaaaccagcagatcactggcttaattaacgttgatatccctgttgcggactgggatgccgaagaagccttttttgaaacgatgttggaacaggcgccggagcagcatcaatttaagctggcggctggcaacacgctgaccattcgtccaagtctgccaggcgagaggaagcgttttggccgcgggagcatggaccattttgcgctgacggttgaccacgaagaagtgttaccgcgattgggcaccatcgccgctcaacatggttacgaaatcgaggaattcgccgaccgcggctggtttaagagcctgtacgtgcgtgatccggccgataaccgaatcgaatttgcaactcaagcaccgggcttcactttagatgagccgctggaacatttgggtgagcgccttggtttaccaccgaaatttgaagaccggcgagccgaaatcgaaacttatttcaaaactaaaggagtggatttccatgattgaacatccattattaggtatgaaccacgtgaccgctatggcaagtgacccacaagcgatttttgattttatgagtaaaacgttaggcctgcatttaattaagaaaacggtcaaccaagacgccttggacacctatcatttttattttaccgatgaccaaggcacggccggcaccgacatgaccttcttcaccttccctaatcaggaaaaaggcaaaaaaggcaccaacatgatctcgcgcgccagtttccgagttcccagtgacgccgctttggactactggttgaaacggtttgctgacaaaggggtagcaaatgacgggattagcacccaatttgacgcgaaaatcatcaatttccacgaccaggatgatcaacaatatcagttaatctcggacgaacacaatcacggggtggctggtggaacgccatggaagcataatgatgttcctgaagaattcgcaatcaccggtctcggcccagtcaccgtcacgatttttaacctcggccatatgcagtatgtgctgaccgaaatcatgggctacaaacagattgccgaagatggtaactggtcgctctatgaagttggtgaaggtggtcatggtgcgcaagtgattctagagcatcgcgaggatctgccaatttctgttgaagggtttggcaacattcatcacgccgctttttctactgataatcgtgagactttgggcacctggattgatcggattaagcaatatcggctgccacaatcaggttatgttgatcgcttctattttaagtccgaatactttcgggccgccccgcaaatcctgtttgaactggcaacaaccggtcctggcttcttacaggatgaaacttacgatgaagccggtattcatcttgaattgccgccatttttggaaagcaaacgtgcggaaatcgaacgcggtctgaccccggttaaaaccgattggcgcggccgctaagcaacggaggttatgatggcagaagaaaacgtaaattatacatttgtcaaaggcgatcccagtgtgtcaccattattgttactgcatgggcaaggtggcgatgaaaatgatctgctgccgattggtaagtatctctcacccaatagtccgatgctttccattcgtgggcgcgttcaggaacaagggatgaaccggtatttcaagcattccgaaaacggcggcttcgatctgaataatcttgaacaggaaaccacttggctgtttaaggtactaaatgagctttgccagaaattcaacattgattatgagcgtttcattgtggtgggctattcaaacggcgctaatgtagtagcccgagcccttttaactcgcagtgacacttttcacaccggaatctttttccaccccatggcgctttcaaccgttgattccaaacaagatttaagcgatgtgaaggtttggatgtcccatggcgatcaagatccgattgtgccggcgcaaaacttcaaggtgttggatacttatcttgaagaacaaggcgccgaggtcaccattttccgccatgatcaaagccataatttgaatgaagcagagttagcaaatgccaagtcctggttagctaatagcggccgattgcaggattggcaacggaggtgatttagatggaacgttttgggtttgaacaatatggtaacccaagtgtctttgaaagcattgaggcgcctgtcccggagccaaaagccggtcaggtgcaattgcaagtgttgggctttggccttaacccttatgacgcttcgttgcgccgtggtgaacaggcagcttttcgcaaggttaagtttccggtcgttccgggtacggatgtgcttggccgcatcactaagcttggcgaaggcgttagtgagtttgcagttggcgatttagttatgaattatcgacccattggcggttacagtgaatttgtcacggcatcaacttctaagatctataaaaagcccactgccttgagtttccttgatgcagcagcgctcccccaagtcgggttagccgcatttaacattttgcattacatgttggcacttaagcctgggcaaacgttagggattgtcggtgccagcggcggtgtcggagcgatgttggtacaactcgccaaattcgagaaactcaatgtgattgccgtagcgggtgagcagcatcgcgagtatctacgtcaattaggcgccgatcaaatcttcagttataccgatgaattgcctgagaatacggccgatgcagtgatcaatgcggtttttggtgcagcagatcatggcgcggcattgaagctggtcaaggctgatgggcagtatgtgacgactgcctatgccgacgttgatctcatcaccaagccaaccgttgaacatctgcagttaaatccatccaagacctactcagtccacgatggctttgcttatctcgttgacgttgcccaaaaatgggggctgcaagttcgcgttgcccagaccttccccttcactgtcgccggggtcattgccggccatgaaatgctagagacccatcatgcgccgggcaagctagtcgtcatgcaagagcggcatgtaacgcacccagttcgaaaagaaatcaatcacctttaaccagcacttaaaaactgcttgcgactcgccaatccgcgccgtatgataagcgcgtgactggaaaggcgggacgatatgaaaattgcagtatattgtggtgctaatcgtggtgttgatgacgcattcgtgcaagccgcaacacgtgtaggtgcatggattgcccaacgtggtgataccctgatttatggcggtggcaaactcgggttaatgggcgcagttgcccaaagcgccttgaaacatggtggcaaagtgattggcatcatccctcaagtgttagcagatcgcggtctggctctaccgaatctgacccaattagaagtcgtcgaagatatgggcacgcgcaaagcacgcatgattgcgttagcggatgctgacattgcccttcccggcggtcctggtacacttgaggaaattaccgaagcgatctcgttttcacggatcggattaaacgctagcccgacgatcctatttaaccaaaatgattattaccgtccgctacagcaaatgtatcaaactgcggtaactcagggcttctttgatcaggacgcctttgacaatgtattgttctcgtcggatttgccgacaatcagcagcttcattgccaactatcagccacttggcgttcgtcaataccattagcagctggttcttgaatgctatttcaacttgatacaaaaagcacgccgttccattcacaaagaatgaaacgacgtgctttttaactacttaggccaaagccttcttagcagtgtctgctaatgctttgaagccatctggatcgctgactgcaagatcggcaagcatcttacggttcatgtcgacattagccaccttcaagccgtgcatcagcttgctgtaggaaatatcgttcatccgtgctgctgcgttaatccgggcaatccatagacgccggaagtcacgcttgcgagcgcgacgatcgcggaaagcataacggtatgaaaccataacttgggcattagctgccttaaacagcaaatgcttggcaccacgataacccttagcgagcttcagtaccttcttacgacgcttacgagtaactgttccacctttaacacgtggcattagaattcctcctcaaatcaaatccgattgctgattatttcatctggctgagcatctggcggatccgcttcatatctgagtgggataccaatgctgacttgcgcaattgacgacgctgtttcttcgtcttgccgtggaaacggtgtgacgtatacgcgtgaccgcgcttaagggcacctgatgcggttttcttaaaacgctttgcagaagcgcggtgggtcttgaattttggcatgtctttttcctcctctaaacatcaacgcgcgcacagccggttggggctgtgcacgcctttgtatcattaaccgatcagtaattacttttcggctcgcggtgcaagcatcaagaacatgctgcggccgtccatttttggatgggtttcaacagcagcgatatccttaacggcatccgccatctgctcaagaaccttgcgaccaagatccttatgcgtgattgcccgtccacggaaccgaacgctgactttgactttgtcgcctttattcaggaacttagttgcgttcttcaaacgggtattgaaatctgcttcaccaatagttgggctcaggcggatttccttgatggtgacagtcttttgtttcttccgagcatcgcgctctttcttctgcagctcgaaccggaacttcccatagtccatgatgcgggctaccggtggcttggcattaggcgatactaggacaacatctaagtttgcatcctcggcaatggccaaggcgtcacgcgtactcttaacgccgagctgttcaccggtctgggagatcaatcgaacttcacgtgcgcgaatactgtcattgactatcagatctcttgctatggttgttcacctccgtgtgaatttcagagaaaaaacaaaaacagcgtagccacaaaggccccgctgttcattaaataccgaactaatgagcctagaggtctaaagacttgggcgagaagcgggaacttctgctttttctcaacgtaaataactatacaggaattcaggagtaacgtcaagccactgtcgaagatgacagagagcagttcttctacaaaggcatacagggaattatttctcaggcataaatagctctgataatgtccttctttttaattctttcaacattgaactttgggccatgtcaaaaatttccttgctctttaaaagcatatattctgcttcctgccggtggataaaagtgttggtatcaaagtcatcatactgcttgaataattttacgtcgccttcaatagcctcaaaaacatcatagaatcgaattgactttgctggcatcgctaaagcaagcccaccgttaacacctttctttgattcgatgaagcccttgttttttagcaaagcgactaatcgcttaacgctgggaacgggtatcgctaatttctctgagattgcttggattgttagatacttcgcctcttcgtactttgttttcaactcaatataaaataagatttccaacgactgagaaaagccaactgaatatgacatttagacctgcccttttacttcaaaatatttcccgacagttttcaaaccatactgccctatgatttaaatactcatagcggctaaaatctgttaatcgttttattttaccataatcgggttagcttcagggttaccgattcttaaaacaaaactagattagtgaatggtgaaaaactctaaaagtgttttcataataggctttaccaatagttaagcgtataataagtgcaagcctcatttgcccgaaatgcctatgctttgggatttacccttgcacttatcgctgacctatcggaggaattgatcatggtttatcgtcaaaaagcaacgcaactgtcacttgaatcctttggaagcgctctgggaacaccgctcagcccggacaacgagtgggttcaatatgcagaattgatcccatgggccaaacttgaagaggcataccaattacagttcccttcaaaaaccggccgagcagcgaagccatttcgattgctttatggcgcaacgttgatcaagttgaagaaaggcctgaccgaccgccaagttgtcgacgatatccgtgatacaccagcctatcagtacttcatcggattacccgaatatcgcgctaagaagccatttgaacacacaacgttggtgcactttcgccaacggctttcagccatctcagatttgatccgcaacattactaatgacttcacgcgcgagcggttggaggccgatctacctgaggggacgcatgttttgattagtgatgcgactgccgttccggtcaagatcaagtatccccaagatacaacgctgcttaaccagagtcgtttgaatctcgaacaaatggtcacagatctggcccacgggttaggtgtggaaattccgcggacatacagacgtgaagcaaaaggtaagtggaccgctttttcgaggaaaccgcggcgtcaaaacaaggaacgccgcaaacagcttcaagctcagctacaatacatccgaagagatctgcgatatgtggcggaactgcttgcgcaaggcggtcagctcactgattggcaagcacagcgtctggaagtgattaaacaagtctatgagcagcagctcttcatgtttgagaaccacactcaccatgtcgagaatcgcatcgttagccttcaacagccgtatatccggccaatcgtgcgaggtaaggcaaagcagtccgttgagtttggcgccaagattgactgttccatgttggatggcgtgattgatgtagagcgtttcgacttcaattcatttaacgaaagcactgatcttgaagtaacgcttgaccatgcttttgacctagtgggtgaatatccggatgaggtgctggtcgatactctctatcgcacgcgagataacatcaatctgtgtaagaagctaggcattaaacttaatgggccaaagctgggtcgaaagcccaaacatgtggatccgaaacagcgcaaagccgatgtcagtgcggaaaatcgtcggggtgccattgagcgcaagtttgccttcttgaaaggttcacttgggcttgacttagtgaacaccagaacggctgagtccttggtggtaacggtggatagcgcgattgcattggcaaatatcgacctcctccttaagcttttttctgtaccaatttctattgtggtcgaacagggtggcctgcattatcaaatcaactataaagtgactgaaattcggccagaaaccgcaacctaaatcaccagccactagattaactaattcaccatactactcgttcattgtttgttttgcagagattcggaacctttatagctaaatttgatcttcatcttcaaccctactttttctcaaaacaagggtcatgacaaataaaatccccataatgagcaagattgctgccaaaatcataacattttgaaaaatgtgaatgacactcgttgtcccggacgtaacaaccaaccccaaagcaagccccaaagccgcaccgaattgtctggtcgtattatagacgccagatgcggctccgctaatgttttcagggatatcagccattgccgaagaagttagtggtgttaaagccaaggcaaatccagcaccgaacgtcaatgtgaatggaaaaatgtaccaatagtttgtcaaacctgcgaaaacggccaacccaactgccgaaacaaacacaagaaagaggcctacaagcataacttgactattaccgaataattgcacaattttccgcgcttgtaacgcaacaaagaatagcaaaattgacatgggtatcattccgatggcggcaataaacgcagtataatgaaattctctttgcatgaactgaggaatatagaaccagaaaatcactcctgccgccgaaaataaaagtgagccaatgtaagaacccacccgcacccgattcttaaaaatgacaagaggcatcatcggcttagttgtgcgtaactgactgataataaacatgagccaaaacattccggaaagcgttaacgttaagattggtctatgactgccagcaagactataggttagtgagaccatagcaagcacggacagtagattacctacccaatcaagttcgacggttttcttttgacggttcgataaaaccctcaccgcaacaactcccattatcaaagctagcggagcattgattacaaaaccaagccgccatgaaacaaacgctgcacagaaaccgccaaaagcaatcccaactaccgcaccagctccaatgacggctgcatagtacccaatcgccttttgaagttcctcgcccctgaatgtgtccgttatgatggcaagacaggttggttgcaaaatagcggctccaataccctgaattgtcctgaaggtaataatcataggagcgttcaccgatagacctaccgccaaactacctgtagcaaatagaagtaaactgataataaaaaagttttttctgccgtacatatcgccaagtttgccacctaacaacataaaaccagcgtatgtgagaacataacccatttgaacccaagaaagctgactaggtgttaacgacaactgtgctgccaactcgacggttccagtatagagaatgcctgtatcgagaaccgttagaaatgctccaataagtgcaaccatcatgataacctttttcttcactgtcaatacttttccttctttcattgctaccttacgaattgcaccataagattattagatataacctaaatatacctattaatctaaaaagcacctgttaatctcagtttttacctcgtcacaaaataaaacgccactggatttctccggtcacaagccaacaactaatggacttaaatttcgtgctacatcaatacaacgcgtggtatttctctgataaatcaatgaacaaatcgtttatattttgattaatcgtaagcacaccatcttctggggaagccgattcactaacaacaatctttttaatagcactcgggaagctgcttgcccgacgtttcgttccaagaatgagaagcaaatctgccgactcgatcattttctcaccgtttgccacctcatttggataagtccttagatctcgataaacaaaatccgggataatgagtcctccacagatacgacatttgggaatattctggttttccaagagactccagtcataaagtcggttacaatttacgcaacggttttttcgcatatcaccccaatactcacaaacctgccgactgccggctttttggtgtagataatcaatattcatagtgacgacaccggctaactttccagccttttcaaggtcaaccaaaaaatgatgacaactgtttggccgtgcatctgggtgaaaaaatgtttttcgataaatacggtaaaacgttgctggctcacttcgcgcaaaacgttgactaacaaggttataagcgtccccatgatagtcactgtctcggtttaaaatacttaaaataccatcgacatcgggaattcccgaatcggttgaaactccggcaccagtaaaagcaacaatgcggtgactttctgcgattaattcaagcattttggatattttgcacataaattcttacctccttcaattaatgttaaaagtatattccaattatacttttaaaacaacgcttttcagtcttttatctatatccatcttgtcgctgatactacttttgttagtatcttttccctacctgactaacaaaattttctggaattgaccacggccgtttaaattgactatctttataaaaaaagcagatgcccaaagacggactctgcttaaaataaatcattgacttcactttcaaaaatcaaacaatcgtcaacgccgaaatagtgttttctccagctgttaccgttgataaaatggttcaaactcaccactcacataccgaccaagctcattatcagccggactgacatgaaattgcagcgtctccggtaaataggcttctgcaaaagcaacaagcgcatgcaagtcggcgttttcgtcagcatccactaccaacaataaactcttggcatcgttggctcgaatcatggttgctaaatatgcagcgtgaatcgttgccattttcggcaagtacgtttgcagacgtgaaacaagatcagccgcttctttaggcggttcagaaagacgaacagcctcgccatgttcggcttgatccggtttagcaacataaaacaggttggcgcgggttaagaccatgttttcgccatacggattgattacaacgccctgaatatcgtggtcttcatagagaaaattcgcacaatcgtcaatggttgcaaccgcaaaatggtcatggtcaggactttgggcaaaactggcctgatcggtaaaaatgggtaaaaaatcgtggccattatcatccgtcaacagtaccactgtcggatcccctgtccgcgccgtgccaaccggtaacataaatttagctgtttttaaccccgcgtaaaaagctgctcgcgtttcatcattttgatcctcacgtaataaatgcatcaggtgaatcagttggggatttttaacttgtggttcatcactcatcatggtcatctcctttatcctgctgttgatccgcgttaattttttctcgaaaagcgcgtaattttttaggtaatccaagtagccaggacaacaagacgatcccgacgctaccgaaaaccgcaacgccttggggctggaattcgatcttgccgaaccaccaatttgcaatcccatatgcggcaaccgcggttaacaacatcacgaatcccatgatcatcaataatccgcggccacgatgagcgattagccagtagccgcgttgattaggggtgcgccacggcagtttcatatagatcagcaagacagcgaagtataagaccgctgctaatattttggtaacgaagaacaagacgagccaagaagcccataacgcaataaacacctagtcaccctttctttgatgtgggttttaaatgagtttagtgtatcatacatcacaaaatgtcgtgaaaccgcgagatctttatcctaagattgcgctaatccttcaacggcaattaaaaagatctgagctaaattgcccagatcttttcgttggaactaaatgaattagtcacctaaaaccttattagcttcgcccggcttggttttgccgtcgcgactgtagttcttaacctcagctaccatcgcatcgatgaacatattacccgcttcttcttcagtatgttcatcgccataccgccgtacggataccgccgcatcgttgagttctttgtccccgacaacgaccgtgtatggaatcttcttggtttgggcttcgcgaatcttataacccatcttttcattgcggtcatcgactttgacgcgcaacccggctgcctgcatctggcgtttgatgcggttgacatagtctaagtgcagatcattgttaaccggaatcaaaacggcctgtgttggtgccagccaggttgggaaagcacccttataaatttcggtcaggtaggcgatgaaccgttccatcgtaccgacaatcccacggtgaatcatgacaggccgatgttcctcgccatccttgccgacataagtcaagttgaagcgttccggcaacatgaagtctaactgaatcgtggacatggtttcatcgttgccaagcgcggtcttagtctggatatccaacttcggaccataaaaggctgcttcaccctcggcttcgtaatagtctaggtgcaagtcatccatagcgcctttcaacatgctttggctacgggtccacatttcgtcatcatcaaaatacttttcggtattcttaggatcacgataagaaagccggaagctgtaatcggtaatgttgaagtcttcataaacatccatgatcagacgcagaatctttttgaattcttcttggacttgatccagcgcaacgaatgtgtggccatcgtttaaagtcatttcgcgaacacgttgcaaaccagacaaagcacctgatttttcataccgatgcatcatccctagttcagcaatccgcagtggtaattctcgataagaccgaatgtgatggttataaatctgaatatggcttgggcagttcatcggacgtaattcgagcatttcgccatcgcccatgtccatcggcgggaacatgtcttcacgataatgatcccagtggccggacgtcttgtacaagtcaaggttggcaagcacaggggtgtaaacatgttcgtaaccatcggcgatttccttgtcaataatgtagcgttcaatgacccgccgaatcgttgcgccatttggcatccagtacggcaacccagcgccgactttaggatcaacgaagaaaagatccaagtcgcggccgataacccggtgatcacgttcagccgcttccttacgccgcttggcatcatcttcaaggcctttttcgctccaataagcggtcccgtaaatccgctgtagcatcggattgctgctcttaccttgccaataagccccggcaaccgacagcagtttgaaatgcttcaaatccttaagactcggaagcaagactttttcttcaaaatcaacaaaatcgcctagcttataacccttaatcggatcgccggcagcttcgaccagttgctttttgaacggatcgtccttaaagcggtcaaaagcctctgcccgactgagcaccactggctccaaagcagcgttagccttaatgatttcttccattttcttttggactgtcggtaaatcatcaacactgacttgtccatccgcacgatcggtatcatagtaaaaaccgtcttctatggcttggcccttgccaaaatggatatcagggtacaatgctttgagtgctgctgctaaaacaaatgccgccgtctgccgcaaaaccgtgagcccttctgcatcatctttggtcataatctgcagcttgccagaatgggcaatcggttcattgtatgcaatcaattcatcgtccagtttgccagcaacggccttttttgccagactattgctaatgccttccgtgatggcttttaccgttgtaccatcagggaattgtttgacactgccatctggaaacgtaatatctaatgccataagtaagactcctttgtcgttttttcgaagaaaccattttaccgagtaccacttctgagttggggaggaaaaccgcgctggctcgcgctcacaaaaaaatccctgatatctcctaagagacatcagggacgatttgtgatcgcggttccacccaggttgccgacagtcttgctgcgggccacttcattggcgcgtaacctgcgcaacagggccattagggcaatctcgagaagtggttcggatcagatcttgcaaggctttcagccacggccttactctctagtagatgatcctttattgcttccgtcttcgatagttacattgaaccacaatgtccgctttggtgcaagtaattttctgaaagggtaaaataccaagtccacttggtataaaataaatatacttctccggtacgattattgacaaatggggaggcatataccttggaaaacgaaaagcaaattatccaaacgagatttggaagtgctctgatgcgacttcgcctggaccaacaccttactcgtcaaagcgttgtcgatcataatgacctttcacttaacgccttagctagcattgaaaatggtcaagctctcgtgaaattagacacccttatgatgctgctgaaatactacaatatgtcattaaaagatttttccgaaaattacgtaaatgtagccaacaattcagatttcagtaccttgatgagtcagtccatcacaccagatacacgattcttcattcttgatacaaagggcgcaacttcagcaaataactactctgaccaagatttctctcaatatcactggaactcccgtcaatttaacaaggtgcgcaccggagactggttcatctaccgtcgcccaaaaggcagttctaagttttggtatttctttggtgctggtcaaataggtccaatcactcacgatgcccagaacaatcaacatgccaagattgtcaacccaattgcattcacatattatctcacccctgaggacttaatagattttccctggtcgtttcgtcgacgaactaggcaagattggttgtactttttcaatcaatacggcatgactgaaattcaacaaaccgatttccaaggacttctaaatgttgtcttaaaccatatggatagtcagacttcgttacctctcactcctgaaattctccaagaagacgttgctgtataccaacacattcaacgccatgaacccgagctaacggagaaagtcgagcctcgtaaagagagaatcggacaaaatcaactcgccgaattggtgcggctgaactatggttatcaatgtgcagtcactggaatccatactcgctcgttgttaattgcatcacatataatcccttgggcgtcttcaccagaaaatcggttagatcccagcaacgtaatctgtctatcgccactgtgggataaagcttttgaccaagggctgattacatttgatgcatttgatcacactatccgattatcatcacaagttactgaagacactcatctttaccaagaactagccccttttaaaggaaagctgctacgccaacccactaaggataaaccccaaaccaaatttcttgcttatcataatcgaaatatttttaaaggctaaaaaaactatctttagcaccagttaccgctaaagcccgatcccctggaaagctcgtctaagcagagtgatctgtattcaaacatgtcattgtagcatttttcaatttagggagcatattttactacctagatccttaaactagtggtatctaacatcgatatttgcagtgataatagtaatcagcaatcaataactttttagcaacactcactgtccatactacttcagatagcatgtcacttaacgttttgctgtttgtcgttgccccgatgctggccactaaatctagtactcgcggatagggtttttgaaattcgaattcgccgagccattaaatacaacgcattgttcatctctgtgatttcgtgtaaaaactagcgcccttctataaataattatttcaattttgaagattatcaaaacgaatcgccccaacatggcatctagtgaatgaatagtagcgtctattgaaaaaacctttaatctgccaaagggttccggcgattttcaccgtcaacggtaatttcttttgccaagaaccgtacccgctccataatgcgtttggcttttaacatttccgagttgccacggtccgtccctgccaatgactcggttaattcggccatactcttgtttgaactgaacagcgtcggcattttctcctgcatgcgatattgcagaataatgcccagtacgtcatcccgaacccatggactgatgctttcggcgccaatatcatcaagcattaaaatcggtgcccgcttcacgctatcaatctttttcaacacgctgttattgccgattgcgttcttcatttcaacgacaaacgtcggcacatgaattaatgtggttgcgataccgcctttgcttgctaaatcgttggcaatcgcacctaacaagtatgtcttgccaaccccaaacggcccacttaaatataatccctgatgaaacgccttaggatcggcaacaaccgctaaaacaaaccggtttgcggccaaaagtgcatcaagtcggtcatcggttggatcataactgtccaagcttgcatcgcgaatatctttaggcatgttcaccgaggtcaccaatgaggcttgcttggcttcttcgtctgccgctactttcgcatcagtcggttcatacgccacgtcaatcaaaccgtttgccacgacaagcttgggttgatagccaggcgccaatggtaattcgcctcgggcaatcttgttacgctcactgacaaattcataaatcttggcagttccgcggtcaatggcatcattggctaaatccgcttcatgctgcttcaggaaagtctggacttccggatcctgcaacgcttctttgaccatcttaaaataccgctcccgccactgtcgggaatccatcaacatggccagacgcttgcgcatatcttccattagttcttacctcctttatcaccaagctgccgaagtttctccaattgggcagccaaggtttgccgatcagcttcactgaccttccttttctttggctgataaccttctttggcccaatccggtagtttttcttgccgcgtgccttttgtttgagtttgacgacgtttttggccagtcgccttttgatgctcaaacgcatggatctggtttaaggcagcttccgggctggttacattggcttttaaccagctgttggcaatcgcatccaacaacgcctgattaatactgtcgttggttctgagaatataatcaatcagaatattaatcgtcggtgcgtcaaaaacattgcgctcactcaattgctgaatggcgcgcagttcgttgttagccggatacatgcgcgcgtttttagcctgtttcgccgcagttaaaaactgccgcggtggcatacttttggcccgcttaagcaatgcctcatcagcacttgctacttttggcgtctgggttggagtttgcggtttggcatgtggctgctggcgcgtatagctttgttcggctagccggcgcagttgattcaaatcgatttttcccgtcataacatcggtcgcgcgactgatcaagcgggcaaaatcaggcggttgcaagccgtaaaatgccgctacttgataaagtgccgcttgatgtttagtcagttgtccggtttgcagattgctattggccaacaacgattttaataagtcccaatcgtagccatccccgcttcccaaccgtggacgatttgccggcttttgggtcacggcttctttagcggccacaacagccggtggttcctggctgaggtcatggtcaaagcgaaacacatccaagaagctggcggtaatctcttgccattccggacgccgcaccggtttcaagctaaacttggctaccaattcatcgtagcgattctcgcccactttgtcatacagcaggagtcctaacaggtcatctttgaaaaaggcatcgggactcaccggtgggtaaagttcatacgcataataacggcccaatgagtcaacttgcgaataagtgcgtaataaccccactgcttccaatttcacgcgcgcaacaaacagctgctcaatgtcaatatccaaaagatccaacagccaaagttgcggccgccgatccgtgaccaaggcgcggtctttgacttcttgccataagctcaggtaaagcgccatcggaaccgggccaactaagggttgataaagcgaaactgccactttttcgtcaaagtcgctaaaataacctgctttggtcaacacaaacccggcttgcggaataaacgtatcagggcgctgcatgacattcacctcttttcagacaacggacctgagacaatcgcctcaggtccgttttgttgattacttcaatcacatttacttcttagtcttttccttcttcatcatatcctgaagctcttgcatgaagacggacatatccttaaattggcggtaaacactggcaaagcgaatataagcgacatcatcgacatccgctaatttcgacatgacatattcgccaatagcctgactggaaacttcattttcaccaatcgcgcgcagttgattttcaaccgaatccacgatcccttgcatttgttccatggtcaccggccgtttttcagcagcccggatgagccctttaagaatcttctcgcggttaaattcttcccgcgtgccattctttttgatgaccaataacggggtctgttcaacgcgttcaaaagttgtaaaacgaaacccgcagttctcgcactcacgccgacgccggattgcccgaccgccgtctgtgggacgcgaatcgacaacccgcgaactattatgatggcaatggggacattgcacgactccaccttcttaatcaaagtttgatagcttattatagcacgtgcaagccgcttatgatagttgctcaagccggtgaatcaaggcttttgcctggtcaatcgtcgcggcttgtgtcccgttgttatcgatcacaaaatcagccattgccgcttttttggctaatggtatttgggaagcgatgcgttcttgggccgcttctttggtcaagccatcgcgcgtcatcaaccgcgccaactgcacctcgggatcaaccgtcaccaccgcaacgccatcaaacgcatcggcatagtcagcttcatacaaaagcgggatatccccgacaacgatggcggcaccgcctgctttggcttgagcaagcgcttgattaatcgctgcacgcaaatacgggcgattaatttggttcaatgcttccatacgtcccggctgcgaaaacacaatgtcgcccagtttggcgcgatcaagggtcccgtccttgcgtaagacccccggcccaaacgcttggacaattcgcgcaagcaccggttgacccggttcaacaatgcgccgggcaatcacatcggcatccaccaccggaaacccagccgctttaaatgtccgacttaccgttgatttgcctgacgcgatgccgcctgtcagccctaacaaaaaggtcatgccagttgcccccctcgatgtagcggctggcaatgcgggcaataatgcgtgccgcgttgaccgactttaattttgacaattgtggtgccgcaacgatcacaaggcgtcccttcacgatcatagacatgcaaagcatcctgaaacgaaccgcgattgccttctgcatcaacgtaagtatgggcactggtaccgccagcggcaatggcgtcgtccaattccttgataatcgcatcatgtaacgtgtgaatctccgccttggttaaggtattagctggctgcaggggattgagcttgctgagccataaaacctcatccgcgtaaatattaccgattccggccacaacagtttgatccagcaaaaccgatttaatggctttatgatgccgctttagcttttgggcaaagtcactttcgctaaaagtagcagcagtcggctccggccctagcttggccagtgctggcaccaattgctcctgaccagtgtgaattagccgcattcggccaaacttacgcagatcgcggtaacgcaactggctgccatcctgaaaggtaaacgtcacatgatcatgcttatccagcggcgttttggcatccgaaacaacgtaatagcggccttccatgcgcaaatgactgacaatcgtcatgccgttgttaagccgaatcagtaaatacttaccgcggcgatcaatcgtgttgacagcagcgcccacaacctgtttttgaaaggttgccagaccattaattaggattttctcccagtttgtgctaatcgcggtgatttttttatttttgactaacggtaacaaggaacggcgaaccgtttcaacttcaggtaattcaggcatgagttctccttatttcgcatcaaaccaggtcggtccataatgactttcgactttcaaaggtaccgccagtgaaacagccgagtccataatcttaggcactaattggccaagttgcgccatttcagcagtcggagcttcaaaaatcaattcatcgtgtacctgcagcaacattttcgcctgcagatgggcctcatccaacgccttttgcatgcgaatcatcgcgactttaatgatatctgcggcactcccttggatcggcgtattcatcgccgttcgttccgcaaacttgcgcaagttgaaattgcgggagtgaatctggggcagataacgacggcggtggaagagcgtttcaacatagccgtcttcacgcgctttcttgaccatattttccatgtaatcgtggactttcgggtattgttcaaaataaccgtcgataaacgccttggcctgtttccgcgaaatcccgatattttgtgctaggccatagtcactgatgccgtatacaatcccaaagttcgtggccttggcttgccggcgcatatccggcgtgacctcatcaggtgaatcgaggccaaaaattttcatggcggtatttgcgtgaatgtcaacgccgtgtttaaaggcttgctgcatattctcatcacccgaaatatgcgataacacgcgtaattcgatttgcgaataatccgagctaaaaatctgccaatctggatgagaagggacaaaggctttccggataatcttaccttcatcccgtgctggaatattttgcatattcggatcaacggaactcaggcgcccggtttgcgtcagtgtctgtaaataacgggtgtgaattttatgatccggcatttgtgctttcaacaaacccaccacataagtcgagtttagtttggcccagccgcgataatccagaatatcctgaacaattggactagccgatttcaattcgtttaaaacatcgacactggtggaataaccggttttggtctttttaatcactggtaaattaagtttttcgaataacacttcgcctaattgctttggagaattcagattaaatttaacgccggcttcaccataaattttttcttccaacaccttaatgctttgcgaaaattcggttcccatgtcctttaaggtttgagcatttaacgtaataccttgaatttccatttctgccaaaacccgcgccagtggcatttccatgtccgtgaaaagatccgtctgttcctgtttagccaagtcttcggttaaatcaggacgcaaggcgaataaggcctgagacttacgagcgaattgttcaaacagcagtttatcttcaggcacttgacgcttagcacctttaccatatacatcttcatcgcgaggcaagtcatgataatcatggtcttctgcaattttacccagatcattgctattttcatctggattaatcagatacgaggccaacaaaacatcgaaggcaatgtccggcaacttcaggccaagacgatgagcagccacaatattgcgcttgccatcaaacaccgttaagtcgcggtttgaatcaccaagccacttagcaacttccggaatcgtcaacaatgacacatccgtgctgacgtaagtttcttctttagtcccaatgaaaaagcccacttgttcagcggtatgataattatccgctaacatttcaatctcaaaggttaacggttcggttgttttcgtgagcgccaaaattgattggtcatccaaaacggaatagtgtacaggctgtgacggttttgcaacatccccgccaattttcttcaacagggaattcatattcatcttagtatagaaatcgcgtaacttcgccaaatcgggaccgttatactttacgtctgcaagatcgatggtcacaggtgcatcgcggtcaattgtggctaactgcttgctcaggtacgctttgtctttgtcattgatgagactttccttcattttggaagtcttcatcgcatcaatgttggcgtaaaggttttcgatactgccatattgctttagcagttttaaagccgttttttcgccaaccttggtgacccctggataattatctgacgtatcacccattaacccctttagatcaataatctgagtgggggtaatgccaagcttttctttaacgtgttccggcgtgtacgcctcaagttcattaacgcctttgaccgtgacctgcaccgttgtttgatccgtcgttaattgcgttaaatcacgatcaccagtcacgattgttgtctgccaccctgcatcatcagctcgcttagccatcgttccgataatgtcatcagcttcataatccttgagttcataatgctgaatgcccatatcgtcgagtaattccttgatatacggcagctgctctaacaactcgcttggcgtcttcgcccgaccgcttttataatccgcgtatttagctgttctaaaagtcgtcttgccagcatcaaacgcaaccaaggcagcatctggtttaaccgactttaaaacaatctcgagcatattgttaaatgcgtagatggcattggtgtgcagcccatcttgattggtgaaacgatcgagttgattgtacagggcaaaaaaggcacggaatgcgattgagttgccgtcaatcaacaataatttagtttgactcgtcatatatgagcttccttttcttctcaaaccaccgctatcgatgacatgagttaattgtcatcattattgtaccaaattctttgcctttgtgacggcacgttcctagttaagggggatcatctcatagccgttgcggtttgataggttgcagtgggtggtggccgtccattgatacacgtttcttcgtgcaaaagcttacgtgtaaggacattgaacgcaatggcaaagaccgggccatcatgcttaaggccgcttacactctgagtccttgacactcactttctataacgcgctccccggcgcagaagtctgcgtgtaaggaccttaagcgcaatggccaagaccgggccatcacgcttaaggccgcttacactccgacttctaaccgcgccggctcgcgctcacataaaaaaagccggtttctgaccgacttttgcttttattaattgttgttgtcgccaacgcctaggatctgcaagatggcggtgaataggtttaagaaatcaagataaagcataagcgccccgacaacggctagtgagctggtggaaatagctgcttgtccatcgctgccagccgtcaagtataagttcttcaggcgctgagtgtcccaagcggtcaacacgatgaagatgatcaagatcgcataagaaatcaacatctgcatgccgcttgaacccataaacatgttaaccaacatcatgatgatgacgccaaacaatgcagacatcgcgatatttcccgccttactcaggtcacgcttgccaaaatggccaaccatggacatgacgaaaaagactaccgccgttgttgccaatgcaactgcaaggttagatgtctttgcaaccatcgcaacggaagcaaaagtgaaaccaaaacttgcggacatcagataaaacattaaagttgcataacccggacttgcctgggcccgccgtccagtcacaaagaaggacaggatcagcggcaatgctgtcataatccaaaagataattggatgagcacccacaaagttgatgtaatcattcttaagggtaactcctagtaaataacttacgagcgccgtcacaaccagcccgctccccatcaaggtgtagatgcgggagaagaactgcgtcaagccggcctcgtttacaacacggcgttcttgcatattgcgttcattcctttcaactatctataactattataaccagatcaaaacattttgtcagtcaggccaaagaccgatttgcatcttggtgagtcaaaccgtcaagccctgatactgactttatcatgctagtgctaacattaacagcccgacatgcgcttgtccactggcttgtatagatcgtcattgctttattgcatatgtgtgaatgcgatctttcggaggacaagcaagggaaaatactagatttatttataattaattactattaatttactaaagttcacatccgctcgtaaaatcattgaccggcatacgtttatctgttaatttttaatcatcgaaagtctctctcttaaaataaaggatgtgaataaataatgctcatgtttttttatggcaccctagctatcatactgattacgatgctcttatttagaaagaatccagcgattaatcgaatctcaagtgctatcatctcgtcatcaaaagtgggagcgctatgtcgaacttgctttttaatcgtgaatttcattttcttttatctgtttgtgacccgcgacttgttgactttatttacaatcgcgatggtcgccatcatgtatcttgccgttgactggagtcgtggtctacaaaggagttgaacgcatttcggttaataaagtacgccttgaatgccacaatgagtcgttttttttcatgcaaaatcgagatgcgaaaaaagctaacccgcgatggattagcttttttgtttaaccgcagatctggtcataaagcccatttcttctcagagataactgaattgccatcacactggcaacacagaacagatgtcttgaaagccttcaaattaagcaccgcgatgatgccgcgcataacgtttgaacgcaattacattaatggtgaggagtacgactaaccctgctaaaatcattaagcgccagtcaatcgcattcgcttgggcaggtgcttttttaacagcggcagcattcaggtcatcggcctctttttgcgcgaccataaatgttttcttgaagtgccatgttctaccgcctgcctttgcgaccccctcaaaacgatattttcccggttttaacggttcatcattgagatcgaccttaaaattaaagtttgagttcggtgccatcttgagttcgtgcttgcgcgtttgatacagtgttttgcttccgtctgcctcaaagatcttcccttctacagtcaggtctttgagcatcgccggttcaaagttttgaatattggcttgaatggcgttgtgaccatgatcactgaccgccttcacttcctgcaccctcaagttcggtggcacgacttgatcagattcggttaaaacaacaccgagtgcgtagacataacgattagcaactgcgccactcgttgtcgctttttcatctggtttagccataaattgcaggccaccaagaaccgtcccggcaaatgcctgcgcgggcaactttaattgcaaaggtactgtttgttggcttaaagccgggatcgtcacttccgttggggcctttaataacgttttgagattgacctttaatgacgcatccgttcgacccacctgttcgccgtattcgaccaccccattatcgtttgtgaaggcggggttcaccttgatgagcacggtcacgggatcagcttgacgattttgaatgacaacgtttaacgtctgcgcttgattcggactcacccgtaaatcaaagtagctcgcacttgtaccccgctgattttccggcaactcagctttgaccgtaaacccttcgcctgccgcttgtgcagattgctgccacatgccggaaaagagtaccatgacccaccccaagagaccaacgatccatatactttttttcatcttttgtgtggcaccatcgacgcaaacgtgcaacggcgcctcctttcttagtgttttagttttcgagattgatgcagataatatgccagtaagagacccagccagaaaaagacgcctgctaagacagttatcagatatgaagcttcttgtagcgctggcagttttgcaggcttagtggctttctttttgcttatatcggccattgccggcttctggcgagaggtaggcagccgatcatcgcctggcgaatccggcgttacaaccttcacaattttgggatcgctcatcggctcaaccagaatgcgaacatgagccacggaagtcttttcgtcagcatgggtcatcgttgccggtgccgcaacaacaatgccaattaagactgccacccacactagcctttgatttgctctcatttggttttacagtggcgccctggtcagcgtccaagtcagcgtggtggaaaaatctcccgacttgagcccttccgttgcataacttttggctggcaccgtcaaggcaacccctttatctgcttgtttctgattaaacagatccatgaaggttcctttagccgtttgaccgtcactaacactcaaaatatcaaccgcttgcgcatcgccagtgtagaccttaatcgctttgttgagtccgaaacgcgcactcgcatctttggcttggccatcgataacgctgctttcaagcaaggagattgccgcgtttggcaagaccacggttttggtcactttgccggctttatctttttcttcggacttcaaatcagtcgcttttaaactgactttccaacgatcgctaccaagtcgcttgtcagtgacctgaatgtgattaggcgccgctgttttcttgccgtctttagtcacccactgatcggcttcggcgtatgccacggcatctttaacggcatccagtttcaatggtccaaaattgaagcgagaaacatagtccagtgttaaaccttcgccgccagcatgagtcgtgttatccaccccggcaaaggttcctggcgttttggtttgtggcgctaacgggtttaaaatatccggtttggtgtcggtttgcatgattttaaccgttccttgggtggtaacggtccgcgcatcgtcagcactgacggttgtggcaccataagccagtagccctgccgataatgcaactgtcgcgagtaaagcttggtatccatgatgagtcattggttgattcctccataatttctaaattaagttaaagtggtgcatcgcttagggtccactgcagaccaaaattgtacgtaccggccgtaaagtcaaagtcattaggcgatattttgagcagtactcctgcttgtgtatcatacgtaaacgtgtgttggatcgtttgagacgcaaccgccttaacttgctgatcttgcttaagtttgatcggatagtcatggccgtcttgtctgaaaaagagtaattcttgttttaattcatgctgatgacgatcggtaaacggctgactttgttgaatcaaaagttgccatggcgtcttttgactgcggccgtccttgatccgaatcgtcatcggcgcatcaccaattcgcggaacttctagcgtttggccatcaattttaacggtgccgaaattgagtgctgccggcgcttgggtaaaactcaaggtgccttcagtgacttccaaagggatttggtagtcataggtgatgcgcttgttagcatctgtcaaacttggctggctaacggttaccgtgacggttttatgccccacggttttcaaatcgggaaacttaatattttccactttcaagtgtgactgttgctttttgacggtattcgtcaccgcctcacgaatgggctgtgggtcgctgtgattttcgatggttaaagatttgaagctgacttgattcagtgtcaaaaacttgtaacccgaagccgtcacctcaaacagggactctcttttgttggcgcgctttttcaagggttcgcgtttgcctgcatgcgccacacttaccttgtcttcacgatgattcaccaccacgacatccccaagtttggctttgaccacgcgcttgtctccccattgatcaagaaattgctgcttaggggtatcaccctgggctgccatgctcgtgacttgttgcttttggtcctgcaggttaagcacatcaccagctgctccgtacagactcacgcttaaatacggttcaccggcaaaaacatcgtggacattgcgattgtcatcttctgcgccatcagtagccacgatcaaccagtcgttgccttccttcaccaacgccaaggcaccaccggcattacgcgtgaatagttcgtaaccgttgaaaacaagtgcatcgccatagtcggtcagcaccggactcgttgataacaccgtgccagtgctggcctcaaacttcatggtcacgtcaattggtttgctgatctttgtcaatcgctttgtgtccttgcgcaagagcttatccaacttgtcaggcatggtgacactcagcgctttatccccccattgaatgcggcgatcatcatactcacgcgcatcttttagcatgttgcctaaagtatccgttgtaacgacttcacctaacttcaaagtttgcgattgggtcgaaaatgttgcgcgtttcaccacggccactggaacatcatagtcagcttcgattgttttatctttgccatacttctgggaaaccgtcactgtagccgtggtatccccaagttttgaaacatctggtcgttttttaaaacctttaatcttataggttgatttatccgataatttaaagaactgcgatagtcgcaaatccatttccgctgctgaagcattaattggaatattggctttttgcggtactaattgattcacccgcaacaattggtagccttgatccgtaatttcaaaataaagttcattcttgttggccaaatcgttgaggggctgctcttgtgaatcatgggtatacctgatctttctttcaacgttgacaactttgataatatcgcctgcttctactggctgaacccgatccttcccccacgaattgagaaagtcctgtttgcctacatcaccagatatccattttagcggcacttcggataaatttttaaccttagcgtctttcatcggcacgtgggtgatccccagatacggctcgcctggaaaacgctgatgaatagcatggttatcacgaaaaccgcctgatgttgcaaccacctttagtccatcatcattgattaaagcaaatgcacccccggcatcgcgtcctgaacgcaattcatagccttttaaaatgatcgcatcgccgtaattagcagtcgcggtcggccgggcggttagatgtccggttttggaatcaaactgaattgggactgcggcatctttaaacaattcgtcaatccgttgcgtacctggttgtaagtgtttctcaacttcagacgcttttaacgggtaaagctgcttatccccccaagaaacaggcgtgccatctcgttgctgtgcctgatcaaacatccgctgaatactttgcatcccccagcgctcgcctaagacgtattttccggattttgttgtcaacttgccggcagggatcacattcaattccacttcataatcaaacttggcatacttgccgtcatacagtttttcaattgcccgtacgacggctttcgttttaccaggcttgctgacatctgggcgttccctaaaattgtctgcagtgatattgttattcaggtttaacgccttgggataagcggcatctagttcagcatccgttgcattttgcgggacatcaactggacgtgttttcagctggttcacatgtaacggtacgaatcccactggcgtcatttggaaaaagatggcctgatcaatgttcggaaaattttcctttttcagttgataaactttagaatcacgggcaaagctaattttcccttcagcgttgcagaccttgatgatgtcacccattctggcttgctgaacccggttaaggccccattgattcaaaaagtcctgtttgcgggtctttccattggcaaccgcatcattgatgttaaaataactcagattgatactctggtgatcacgcatctgaacgtattcgtaactaccatagaatcgatcaccaaattcaggcgcgattggcccattgtcattgcctttaccggaagtcgcaatcactttggaagtgccatcttcatcgcgatcaatgaataccaaagcgcccattgcatcccgaccatttttaggatcagatgcaccggaaatgacggcatccccgtaatgcgtttgcactgagccttgaccggttgttaccccaaatcttgaatcaaatgtcagatcaaccggtgttctggcaagaattgtatcaatacgcggatatggttcatttaaccccatcgaccgcgttgcttgcttaaacgcatcaggcacgattgcccagatgcgattatccgtaaatggaaaatttgtaccatcaggatcggtagcctgcttgaaaaacctagcctcatatcccgactttaaaaactcaccaagtgtaaaagcactgtcttgaccggtaatggttgcttttggccgctctgtgtttttatcttcggcttttggcttatcatcggctgcatacacacgagtatcggttgaatgaaagaaacgtttaatatccggctgggtaccgccgagaacggcaagcgttattacgacgctgatgccaatcaacccactacaggcaattttttggatcacctgccgtttatttctaaatcttgacggcacttctgacaccccctttttaaagtcctagcaactatataaaaaaatattgattgacatggatttcattctaggggagtagacgttctcataattctcacatttttatgtgaagctttgagaacttgtagcaagaatcgaatttgtattattttagacttatttattacattatatttcgttgataaatcctgtgcggacaggtcttttaacgaacgactttctgccatcacttatttctattacagctgttttttatcaagctgaaattttcctttagcgtgtcaatattcacaaataatgcataacaaaaagcgaaaaggtttcgcaacagctacgaaaaacctgctcgctttgaaaaattttaggcgttagctcttacaaccttgacgcttccagtttaaagatccgcaacactctcattgtttccttttttggtcaattgttgctaacaatgcccttatttgttctaagtcataacgattttcaatgccagttaataaatagcgttcctttgcctttatttggttagcagccgttgcggagtttgtaatcaataaatcgtacacgcaatcagccacggcattgtcaatgatgacgtgataataaccagctaatgcaacgcgcaaccgagctaccatgcctgctgtgatggaccagtcgtcatgcatacagatcccgacatacaacggcgcatcactttgtacgtgaatcaacaacaacacattcaaataccggcgcttcaaaaaaagcagctgctcagggctaggtgactgctgtgcatggttaaaagtcagcattgccaattcaccagccatcttttctaaatgttgtaacaccgctggatcaacctgatagttaatgcgctctccatcaaacagatgaaaatggcccgaaaaaaagcgggcatgcatctgaatttggttcaggatgtaccgaattcgcagttgcgtgtcgcctgtaaatcgccgtttgaaagctgggtaagctaattcaattcgagccattaactgtgcgcgaacctttttaatttcaggagttacctcgtccaaatattgagcaaccggtgataaatcacgatcatccaggtccagaatctccatactcgtcataaagatataaaggctggaaacttcaaattcgtcaatgacaagtgcatattggcgggccaaatcaaacagccaatttctaatcccgcggtaaaggtggttgtgattcagactgagcagcggttctttgctcgtcttaacgcggttctgctccgatgcaaaatgccgcttgagtgcaatgtccagccagatacttaatttgagtcgtccgatcatcgaaaatttcaagtgttcccgagcctcaaatgccgcgataaactgccgcaacgaatacgcttccgtaaacgaggctaaggtgtcataatcatggctatttagtagcaaccgataatacaaatagcgcaacgcaatctcgggaccaatgagggtaccacccttaatctgtaatgaaaatgctgccaaagcctgattcaagagtttgatccgacgaaaaacagctggcttactgatgtatagcaactgtgccagttcatcagcactcactttgcctttttgcagcaaggttagtaaaatccgataacttttcgattggactaacaattgccgatagagctcactaaaattaacgggtgtacgtgtttgcaaacaaatacaacgctgaccgcctgaatcagtcacgctaatatcagcggcagcatcgaagcctctaatccgctgctgaagtgcggcgacggttgttcccattgtgcttgctgacactcccagcgttgtgatggcggttgtgtacaagcaaccggcagcccccgcctttagcaataactgcaacaactgaacctcccgacgttcatcgttctccagaaaatcatcaagattcatagcctactccccctcatcaatagattccctgaaaaattcataacttccttcgttcgacactgatattagatgaatcttaacataataattcgttgaaacaaatagaaatgtaagcggattcaaatcgcctaaaatttagtccttttatgattacaaaacaagcatcacgcattttactaccacgttttcaggatcaaactgtgaccactcaaaaaacggtcccagaacaagcacttgctccgaaaccgttagtcaaacacagcttattcaattgtcatggccgctcatactgtctcagtatcatttcacagtcagcataccggcttgccaacaaagccgcttatcttactcctggctcagcaagtcttcataagccttttcatacttctgaatatcgcctgcgcccataaagacaaccacagcatgatggaatttcagcaacggtcgcatatccgcttgctgaatgacagcggcacccttgatttgcgccacaatgtcttctgagcgaattttgccattcttttcccgcgcagagctgaagatcggagtcaggaacgtctgatcggcttggctcaagacttgaacatattgcggttcatatgcctgcgtccggctataagtatgaggttggaacacagcaataatcgccttgtcaggatatttctgccgggccgcatccaatgttgctttaatctcattcggatggtgcgcataatcatcgacaatgatcatgtctttaagatctttttcggcaaagcggcgtttaaccccactgaagttaccgagttcgcgcgcgatcaagcctgcatcaagtttctccatatgcgcgacagccacaactgccaaggcattcaggacgctatgttcgccaaacaatggcacaaagaagtggccgatcaattcatcatggaagtacgcgtcaaaactgctgccttttgtatcacgcttgacattgcgggcctgaaaatcatcacggtcactggtgccgtaataataaacaggaactttagcttttagtttgcgcagccaaggatcatcgccccatgcgacaatcgccttttggacctgatttgcttcggtttcaaatgcatcgtaaacatcttcaaacccgtgataataatcggggtgatcaaaatcaatgttcgtcatgatcatgtaatcgggatggtaggccagaaaatggcgccgatattcgtctgcttcaaaaacaaagaattttgaatcgcgaacgcctttgccagtcccatcgccaatcagataactggttttagcaaccccgcttaacgtgtgggcaagtaaaccggtggtgctcgttttaccatgcgcacccgccacgccaatgctggtataccccttgatcagctgaccaagaaattcatgataccgataaatcttaagccccatcgctttggcttgcttgatttccggatgctcatcggtaaagctgttaccggcaatcacagtgtaaccgggctttagattagctggatcaaacggaagcatcgtgattccggcagccgccaagcctttctgggtaaacgtatattgggtaatatcactccccaacacttgatgccccaaatcatgcagtaccaatgccaatgcgctcatgcctgaacccttaatgccaataaaataataagttgcctctgtcatcacgaatgttcctcttcctttgcttgtgtgtagtaaacttcgcgcggttttgccccttttgctgcggagaccagatgtttggcctccaacgtatcaatcaggttggcggcgcgattatacccaatagaaaagacgcgctgtaacttagatgttgaaatatgccgttcaccagcaagataatccagcacctcaggcatcagttcatcttcatgcgtattgctagcctcagcggacttgactaaccctgccggatcaaaaagataccttggaccgcggcggcttttgacatacgcaacaatgctatcgatttcccgatcaacaaaggtgccttgtagccgaattggctgactgtcaccattgcctaagtaaagcatatcgccacgacccaacaaccgctcagccccagccgtatcgataatggtccgggaatcaatttgactcgccgtcataaaggctatgcgagtagggatattgttcttgatagtaccggtgatcacatcgacacttggccgttgagtcgcgacaagtaagtgaatgccggccgcccgcgctttggctgtaatccgggcaatgtcatcttgaatctcactacctgccgccagcatcaaatctgccaattcatcaataataatcaccagatatggcatcacctgcgcaaactcatgatgccgcttagcctttgcattgaactgttcaagattacgtacgcctgctgcagctagttttttgtagcgatcattcatcgtcgtaaccacccacttcaatgccgcgctcgccgcttttggatcagaaatcactggcgagaccaggtgcggcaaaccgttataaccggctaactcaactgctttgggatcaatcaaaagcagtcgcacctgttccggagtcgctttatacagcaacgataccagtaaactgttaataaagacggatttacctgatccagtcgctccggcaatcagcccatgcggcattttagcaagattcgtgacaaccggctgaccaaaaagatccacgccaagggcaatggttaacggcgacttagcttcctgaaacgccggcgtgtccagaacttcccgcaacatgaccggacgcggtttcaagttgggaatttcgatgccaactgtattcttaccgggtatcggtgcctcgattcgaatatccttggcagctaaggctaacttcaaatcgtcattcaggtttgtaatcttgctgactttaaccccactggcaagactcacctgaaattgcgttacggttggcccaatcgtatcggcaacgacatgcgcatcgacattaaatgcctgcaacgtttgatccaaccgctgccgctgatgatgcacccagtcttgctgggcggcttgatcagcaacaactggtggtgataataagcgaaccggtgggattgtttcagaagtctcaccttgatcaccgcttgaaacgggcgtggcttccggcgtcgtcatcgaagcaggcagctgtgagctaaccgcctgctgcttggttgtttctgctgacacactgcttgtcgttggctgtgtgactgatgccgtggtgccagccgtactttgcggcctggaaaacgccttttgggaattgtctttctgatccgatgcggattccctagctttttgggcggccaatgctttccgcaactttttggcttcgtgcttacgccttaatgcctcaatgcgggctgcttttcgactattagggccatgagatttgcccatcgatgtcaaagaagtagctatttccgcagtatggcgtgatgcttcgctgccgctcacactggccaccgattgcatcggcggatgcggggcactggtgttatcggatgccgaggagctcgatgttgtttcattggaggcttgttgtgttgcgccatccgcttccgtttgttgtttcgagtcgctcgcttctgaatgctcatcagggctctcagttattgacgccatgctgcttgcacttgtctccagccactcgcttgaacgcgtctcctctggtgccgccactgacgaagccacggcgatcgcaaccgggtcagtggcggcctgcgaactgggactgaccccgtgtccggcaaaaagataaaggctttgttcatccggtttcaataccgccgcaatttggcgatagtccgtttgatcccgctgcacgtttctgacagtgctgttgggtgttgtcagccgcgctaacccattgcgctgatggtcggctcgcggatgtgtcattgcgcgcaaatccgcctgtgcctcagcgactttttgcggattcacttcatgcgtggcttcatgcgtaatctgcggtggcaattgatacgcgtcattttctgattgctgccagttcgcggttgtttccccggattgcgatgctggcgatttattctgatgtaaaaatgccggcccatcataatgcgccatgatcaaatcccctttttatcgtgtttcgacagtgtctctattttagcataagcatcagttcgccgaatcctggattgaaaaataactcggcaaaatcagcgttagtttgaaaatagcctgattctggcattgccttttaacgttaataaaggtaaggatcaaaacgacaccggtagcgccctttcccggaaaaacgtcggcttgtacggaacaggaaaaatgattgacacttaatctataatggagcagattttagttgctataaaaattgtcgttgctacaaacattcattggaggctgacaacatgcttttcctaattcttgatgttctactgatcatatgcggctttgttctattggtatcctgttatcggttctctgaagaagagatcagggaggccttgaacgactgggcattagatgtttttgtattcgctcctattttgggctggattggcaaaaagatgaatgttaggtctccttatcgaaaagccctgttcttactgggattagctatgaccgtcatcttcgcatttaatctgatcgcagaactataggtattgatgccaatatcgtcactataaccgtctaagactcgaaaaaaggctcgtgagcttatctgcccacgagcctctctttaaaattttttgtattttcaccgtagcaattacgcctgagccgcgaccacggccgccgcttccttggcatcgaacggacttccggcagccagattgtccggcatcaccaaaatgccacgccgctgtggtgcccctggaatcgctaattcacgcgcactgctaatcatgccgtaagacgcgaccccacgtagagaacccggccaaataatcttaccatctggcatcatggcgcctggcaacgcaacaaccaccgtctggcctaaggcagcattcggcgcgccacaaacgatttgaacctgttcatcaccaatatcgacctgcgtgacatgtaagtgatcagagtcgggatgatctttgaaatcaacaatcttaccaatgacaaacttgggcttttcgtcaacttcaagctgacccggtaaagcagcttgctggatggcaacatttaattgagccacctgttcagcggtcaattgaatctgcccatgtccatccacggctcccaaccactgactgacattaaaaaagttgtagccaatcacatgattctgatcatctaaaattgccacaatatccccgctgcgttgcgatgtctgggtctcagtatccggtcctgtgatggcaataagcgtatcaccaaaagccggttgattataactggtaatgagcatttgaacctccaaaattaattcaagccggtgatgaaatcctcgacttgttgttttgttttacgatctttgttaacaaagcggccgatttctttaccgtctttaaacgcgataaaacttggaataccaaaaacacccatctcctgggcaacttccagattcttgtcccgatcaaccgcaacaaactcataatccgaaaagtctttttcgatctctggcattgctggtttgataaaacggcaatccgagcaccaattagcagagaagaaaagcattttcttaccaggcttttttacctcatccaaaatcgctgcatttgaacctaattccttcatggccaacatcctttcgcttactaattataagtagactatagcaggaaaactttcgcagcgcaatgccgctcaccgtcttttacattatacttaaaacagcggtgtggcaatccataagcaacagagcgttcgccaaggctggcgagcgtgtttcagcgcaacgtcatcctgcgcttatccaagataggcatgtaaaggttccattttcagcagtcaagacgtgaacacactgaaattacaatggctaaacgcaccagctcacgtcaaaaggaggacttcacgatgtccatttcaaggtctcgattactttccggtattgggctgtcattagcatttattgccactggtacggcgcttgccgggtattggtgtcaccgcaatcaacgaatttccaaccgcattttaaccaaggtaaaacgtaattttgccaaggaaggaaccattgaaacaagttggatcgagctgcaaccactcaccatcaatgaccatcatcagcatatccaagtgtatcgcggcggtatgatccttcgtcattcgaaaatgcaccaagaaatagcatttctagccttggctgatggttcgctatggcgcatcaaacagcagcccatcaccactgcctagattcatgataaaggctgcacgccttagttgccacttaatctattatcaatgcacgctcactcaggccttaaagcgcgcaaccagttcataaattcgaccaccatcagcgctgaacttttcctcgtactctgtcggcacattatccggaatgcgttgatcatgatgaacatcaagcgagacgagttcaaaagtcatgccgaaattgttcatactaaccagcgagtattcaaataagccttgattgtcagtcttaaattgcagccgtgcgtctggcttcatgatcgtttgatattgttgcaagaaacgccgatatgtcagccgccgcttttcatgccgcgtttttggccaaggatcagaaaagtttaagaacaaaccgctaatttcagcttcagcaaaataatcggttaagtcggcaccatcccccaaaaccagttgaagatttgggagttttaagactgcctgtttcttcaggatcatggcaatagcagcctcttgtaattccaaagcaataaaattgcagtctggatgagcctgcgccatcgcaacaatgaattggcctttgccagaaccaacctcaagataaagcggttgattctgtttaaatcgcgactgccactgtcccggcatcttttccggacgaaccagaattagctcaggatgctcggctattaatggtttcgcccaagttttgttacgtaatcgcatgaatgtcttcctttatttcataattgtgatgattcttcgcggtgatcgtttttcccgtgtcgacaatcaaaaggcctgagacaaaaccggattttgccacaggccctttgccacgcgcttacagcttccattcaatgggttgactgcaacgtctcaaattgttgcaaaacttgtgcaacctcatctgttcgctggtgctgtgctgctgctttcatgtcgttcaataaatgcaagtcgccataccaataaagccgattttccaaagattcatcattgttggcaccataggctcttaagaacgctggccatgaattgcgatgaccataatgcgccatgacatcagcaagatcataagccggatcacctaatgccacctgctcccagtcaactaaataaagtcggccaccagcacgcaaccaatttttatgattgagatcgccgtgacagacactttgaaccgtcacccgcggtaaccactgttgtaagtcgctcaaagcacgcttaacccgcggctgatttgtaaggtcacggggaaagtcttgcaataaatcgtggcgtaaccgcgctgggtcaagaatttggccaccgacttggcgaagcattcgttttaataaacttgaatggtgtacctgcgccaacattttggctaccaccggctgcatcatttgctcgcgggttaatgtttcgccgtccaaccattcttgtgccgttaacacatcaccggtgctaacccgacgcgtccataataggcgtggggtaatatgctcgactgaaagtgccgcaagaaatggcgaagcgttacgttttaggaaatacttttgattggcataaaccccaagaaacgcactaccggtggaaccgcctgcaggttgcagggaccacccggcatctaattcaaactccataggcactactccttatatctggccgcaggaatggttctaatcgtcaaaaagacactcccaggcgctcgtgcgtccacgttcaatattactaacttgagaaattcacgtcaagaggcaaagtgagcgcgagccagcccggttagaaaccggaacataagtggccttgggcgtgatgggcccgggcttggccatcgcgttcgaggcccttacacgcagattcctgcgctggcgagcgcgtgatgacaggcgcgagccatcgcacttaaacaagagagctgtccaaaaaccactcgcctctataccaccacatgatgctgcttaagtcgcattcgtgcataccaccgtgtaaagccccagacgaaaaccacgccgcaaatgaaaatagcccctgctgtcagccactgaagccgcaacaatgtcaccaaggtgaacgtcgccacttcgattaaaagcaacaccgtcaacaaccgctcaaatgcagccggtttttggtcaggcgcgaccggatacagatgggtaaagacaatctcatcatactgataataaaaaggtaacagctggaagccgaccatgtaaagaaacaagatagcaaaacccaaagccagccaccatggcgacaacaccgccacgatgacagcaccgatcaccagcaggcgaagatataagccgagatactcaccgccacgtaaaaagccgcgtagatacaatgagagccatgttgttgcctggcgtggtttgactaattttaataatccatccaaataacggcgccgatgcacactattggctaatcctggtacatcggtaaataagttatagaaccgatatacccgacccattcgatcatcttctagtttgatcaaggccatgaaattcaaccgtccttgatccaaaatggttcgcaattgccatctgaaaacaagatccagaatcaatgcaaccaaaagggtcactgccggatgcaaataaaacccggcaaaaaacgcggccccgctaattgccaacaacagtaaccgttgatgatgccactgagtcggtaattgatatcgttttagtaactgcaaccacaagtcaagatccttaaatagccaaactgccattagtaaggtaaccgtcgcactggccgggtctttacccagctgcgcaaacaacggccacatagcaagactggcaaaggtcagcaaaacgcctggcagcagcaagctataatggcggctctttaataaatattgccgaaacgcctctgcttttggtagcaaaaaaatttgatccggtgcttctgcaagggtcgctagctgaccgaagctaagtaagccggtgaaaataattgccaagcataaagctaaccaccaggaaggctgcaaggttttgacaatttggctatacacataaagcgcaccgccaaataaaatcagtaaaatcaagacaaagtgatcattaaatacaaggcgtaaatacttttgttgtgcctgcacatgttggcggaggcgcgtacgccacaagtcaatcatgcttcttcctccgtcatcttcatataaatgtcatccagactgccatcttttaagtcaaattgttgctttaatgatgccatatcaccagtggcacgcacttttcctgctttgatcaaaacaaactcgtcagcatattgctgagcggttgccaagatgtgcgtcgacataagaatcgacgccccctcctgttttttttcggtaactaaatttaacaagtcgtgaattgccagcggatcaagaccggtaaacggttcatcaataataaacaatttggcttgggtcatgaacgccgctacaatcatgactttttgctgcatccccttagaaaacttagccggaaaccaatctagcttgttatctaagcgaaactttttaagcatccgatccgcagcctcccaagccgctttggcatcaagatcgtaagccatgatggtcatttcaagatgttcccgcaacgttaattccggatagagtaccggcgtttccggaacataggcaaggttagaccgaaagtcagtgggattttgcttcaatgttgtcccgtccaagtcgatcgtgcctgtctgtggcgtcaacagtccgataatatgtttgatagtggtcgattttccggcaccattcaagccaattaagcccacaattttgccggatggtactgtaaaactgacatcgcgcaaaacggttagattcccgtagccgcctgttaatccttcaatttttaaagtcatcttaccagttccaatctgtataatttcagttagggatatgatagcatgaaatcaaggttcctataacaaaagcacaaggagaaacgaggtaagagcatgaacgattgcattttttgtaaaattattcgcaatgagattccaaacgttgcggtctatgaagacgatgtggtcaaggcattcctggacatcactcaggtcaccccgggccatacgctgattgttcctaaaaaacatgtgccggacatttttgcctatgacactgagttggcagctgcggtttttgagcgcgttccaaaaattgcgcgtgcgattaaagccagcaatccggcgattaagggaatgaacattttaaacaacaatggtaaagtggcttatcaaagcgtcttccattcacacattcatttaattccgcggtacagcgatcaagacgatttcgggatgcattttggcgatcacagcgctcaatatgacaccagtaagcttgaagaagtagccgacaaaatccgcacccaactggaggcttaagtatgaaatttcgggatgggctcttgttaggtgctcttacgggtacgatttatggcttattgaccgccaaaaaaaccggacgacaacggcaacaagcgatcgctgcttattttaacggcatcgctaccggtgtcggtcaggttcgccaaagtatcaatcaagtcagcgcggcgttaacgcaactatctgccgaagtcgaccaaacccttaaaccggcaatgaaagatattacggccagcgttgagacattcgaatttgaaaccgcaccgcgcacggaagccatcaaagaacatgtggacaatatcaatgatgcgatcaccggacttgaagaaaatcaatctgcgcatccgaccaaaccttaaccaaaacattgaaaataactaccgttggctttatacaagccgtgacggattcttgaaagttatgtgaagatccgcgtacggccgtaagttatggtatagtagacggcagtgttaaccgaaactttttagattaggatgtgtgattacatgaaaaaatggattctcggtgtcgttggcttgttcgtagcagtgaccctagcaggctgttccagcagcacggttgcaaatatgaaaggtgccaaggtcaccaaagacgagtactatgacgccatgaaaaagaccacaaccggtcaggcaacattgcgtaacatgatcgtcttaaaggctttagaacaacaatatccgaataaggtatcggataaaaaggttaacagccagttcaacaagctaaagaagcaatacggctcttcatttgattcaactttggaacaaaacggctacaccgaatcaagcttcaaggatcagattcggacaacgctttactctgaagttgccctcaaggatatgaaaaaaccgacgaccaagcaaattgaaagtcagtggaagaagtatcagccaaagattcaggttcagcatattttagttaagaccgaagatgaagctaagcagatcatttccgattatcaaaaagatccaactgaaaagaacttcgaatctctagctaagaagaactcgattgataccgggaccaagaataaaggtggtaagttagctgcctttgacaacacggacaccagcttggattccactttcaaatcagctgctttcaaactcaagaaagctggcgacattacgacaacgccggttaagacgcaatacggttaccacgtcatccgtgttatctccattgccaaaaaaggtacgatgaaggaacacaagaaggatcttgaaaagcagatctacacctcatggcaaagtgattcaaccgttatgaacggtattattaccaaggtgcttaaaaaagccaacgtttcgatcaaggacaatgatcttaaagatgtgctttcaagctacctcagcaccagctcaagttcttcaactagcaaataagtaagaaattgagtcatgcaaaaacgacctcgcatcatgcgcgaggccgtttttttgttccggtaaaaccataatttaagtttgacgaaggctttctaatcgcaaacagtttgcctttagctcttagtgcggatccggatatgtttgaccatttgtcggccggtagaaacgccgattgtccatgccaaagagtcgttcagtaaaggtgcctggatcgacatgttggtaggcagtcgtcatcatgttgattgaggcatccatttcgtccaaatcgtgcaacacctgggcttcaagtagttgcggccgcaccggcgagccatattccaataaaccatggtgcgctaatacaacatgccgcagcaatagcatatcctcactattaatatcgatctttagttgatgggctgccaacacaatttgttcatcgatcagaacaatatgcccaatcagattcccgggtactgtgtattcagttgaaatcggaccacttaattcaatcgtcttgcccaagtcatgtaaaatcgcacccgcataaagcaagctcttgttcaaacttgaatactgggcaaccacatttttggccaagcgtaaaatgctcagggtatgaaaagcaagcccaccagcaaaggcatgatgattcgacttggcagcaggataactgaagaatgcctttttatgatcttgaatcagtttacggacgattcgattccaattggcattagtaatctcgaaaatgaaactgttcagctcttcttccatggcattgggcgcttccggtgcacgttcaacgaaggtacgcggatcatttccttcttcttgggttgccaaacgcattgagtaaatcttgatctgcgggttgccttgatacaattcccgctttcctgacagctgcaccacttcgccggctttgaactgggcaatatcattttcggttgcatcccagaatttacccgaaatatggccggaattgtcttgaaaaatcatggcaataaatttcttgccattttttgctacccggacttccgctgatttaattaatacaggaagtcgcacatcttcttcattatggtaatcaaaaagccgttttgccacggtcgtcaccttttcctttactattcaagctaattaaatcataccgatgtcagttggaaagtacaaggaagggatcgttcaggcacatggcagcatgaacacagacacgattcttcgttttcaattcctccaccactttgagccgcttgcacgtgtttttgtgggattccatcgcataaaaaagcggttccaaaaagacaagccgtctaaaataaaacgagctttgtcttcttagaaccgattttacttgatctttatcgacatgccacttcgctaacctaagttggtatgttgtttaaagtgagccaataacttatggcttgctttgataaacgtcaataattggttgggagatgatcttattcaattcgtccatcatctgggaaaggccttgttctttagccatcaagttctggatcggttgaatatcacgcatcttgtcgccaagtgcctgcagtgatttcacttcttcatcggtaaaatcctgtccctgcattgacttttgttgcatctcatattgcttttgttggaactgctggaacaagccatatgcaacggtgtccaatttcaaaagatcaaatgccttcttaagatcttggaattcctgagttgtcttgatatctgccgccatttgatttgcggtgtcgtaaacgtttgccatgctttacctcactttttgagcctatttgaaccagctcttaatattatcataccattttcccacagtttccttggcactgtctatacctttatcgatactatcttgaattccttgccaagtgtcatcactttttcccggtgtttggatgctggccatttgggcggcatccttggtgtcaaaggcagtttgaggtgtattgggcatcagcttcgacatttcaagcttgaacaacggtgcgacaccggatgtgctggtaccttgcaaaaagtgctgactatccgttgtcggataaccaatccaagttgcattcacaatatccggcgtataaccaactacccactgatccttggtgccataaccccaactgctaggaacctcggtactgccggttttacctgcaattgtatagccagaaggtttagccgttttcccggtaccttcgttaaacgtaccgatcatcatactggtcatttcctgagcgacttttttggacatgatctgacgcgttgccggatgggaattatcaaccaccgtttcgccgctcgcatcaacgattttccgaataaaatgcgtggtcggcagcttgccatcgttagcaaatgccgcgtatgcccgcgccagcatcaacggtgaaaccccgttttttaaaccgccaagggctgcggctagattctgatcactcgatttgagctgaatgccaaaacgatcaaggctggcaacgcctttttgcaccccgagtttgttgagtaaccaaacagcaggggcattgatcgaatccgccagtgcttgatacatcggaacggtgccaaggtatgtgccggtcgcgtttgtcggggtataattatttttgccgtagctaagcttttcgtctttcagaatcgaatcgtagtgatacccgttttctaacgccggtgtgtacaccatcagcggcttgatagtcgatcccggcgaattacgcagctgagtcgcgtaattaaaccctaggaaggtatgttcgccccggttgccgacaactgcgcgcacgccgccagtcttgggatccagaataatcgatgcgccttgaacctgtttaccatctgctgcattagccggaaatgcccagtcctgttcaaaactggtttgcagattctgctgataagtttgatccagattggtgtagatcttatagcctttattcagaatatcatcaacgctaatcccctcactgcgcgcttcttcgatgaccgaatcaaagtaagatggatatttctgtgcgttggcgtttgaaaaagcatccaccacctgaaccgattgcgctttggctgcatttgcctgcgcctgagtcaatttgtggttatccaccattagctgcaaaaccacattacgtcgcgaaatcgcgttatctttatgatcagccggattataataactcgggttacgtaacatccctgctaaaatggcaccttcactggcatccagttgactcgcattcttgccgaaataacgttttgcagcgtcctgcacgccccaaaccccattaccaaaataggcattgttgagatacatcgcgagaatatcctgcttggagtaaactttattcagttgaatcgccatgaatagctcttgtgccttacgcagcatggtctgcttttgcgtcagtaacgtatttttggctaattgttgcgtgatggtgctcccaccacccataatttgaccatgatggataacatagttcaacgccgaccgcaaaattcctttaatggaaaagccgccattcgagtaaaacgtccggtcttcggttgaaataaccgcattttggacttgcggactaatcgcactgagttcaacatacgtccctttttgaccgtacaatgtccccgcttcttcattgttggcatcgtaaataaccgttttggtctgtaaggtgctcttgatattttgaacatcagcggtttttgctttataagtgaaccaggcagagaagattaggatgaccgtcaacccaagtaaaatgagccagcgaatgacctgaaatcggcggaagaaccaccgaatgctctgccagacacgtgatagaacctgcatgtccttcctcctattatgaatcttatttattgtagcataggccgttgtcagccaagtctcgaccggctgtttttaagcaaactttatgaccgaacgaatcgaggaatccttttgttatttcaaacatccgccattgcccagaatcatgccagcctccgggatcaacttcaagactggctaatcccccggaaacgccagcatcagatgcgcgtggcacaaaccattcaggtcaacggccactaccgccatcttaacgagcccgttaaaaatggtgaccttatctcgctgacttatgatgagcttgtccatcgaacctacgtcccggaaacgccgcatcttaacatccgttatgaggatgacgacttattgatcgtggacaaaaccgccggcatgaaaacccacccaaatcaacctggcgaaaccggcaccttaatgaatcaggctgctgcttatttggctccttttccagcgcttatcacccaccggcttgatatggcaaccagcggcctattagtcattgccaaaaatccgttagcacaagccatcattaaccggcaactagcaacgaaaaccatgcaccgtgattatctcgccgtggttccgcgcgggattccggaaaaaggaacgattcaagctcctattggtcatgatcctgacgataagcgtaagcggatgattcgcgctgatggtgcctttgctgtcacgcactatcatcgaattgccgaaaccgcggatactgccacgattgaacttaatctagaaaccggacgcactcatcagattcgggttcatctagccagcatcggcttccccatcattggcgatcctttatatgcagccactgaaacggccactcggatgcagttacatgcatttcgcgtacgtctgatccggccgctgacgattgagcctctaacggtcaccagtccaagcccgtttcgtcaataagctatacgatcagcgctctttgaatcctcgacccatcatgtcagttagaacctgaaaagctcccataatcgctagcgtttttagctaaccattatgggagctcttttaaaccacaacttacctcaactcaccgatcaaaagcatgacgataagcctcttcaaaccattttgcctgtttttcatcagggctaataacgacaatcgtatcgtggccggcgatggttcctacaacttgatcaaaatcgatatcatcaataatggccgccaacaaattaccattacttggcagcgtcttgatgacattcaggaattgaacccgagtgatcgtcaagccgacttcccgaatcgatcgccccagccgttcaagctgtgactcctctgacccgcgaaaaatcgtatagcgcaaagttcctttggcatcttgggctttaacaatttgcatttcccgaatatcacgcgaaatcgtcgcctgggtagcatcaataccagccgccttcaatgccgccaaaagctcctcttgcgttgcgatcggtttttgattaataatccgtgccaatgcagcttggcgttcactcttattcattcaacaacctcctaagcgcgacccggcgcggttagaagtctctgccgggtcgaccgcgtcatgaaacaagactcaattcatccacacaagtgactacatttcttcaggtgccgccactcctagcaagtgcagggcattctccaagacttgagtcgtcgcggagaccattgccaaccgagccggcagttcactgtcttcaaccaacaccttgacgttggcataatatttgttgaatgccttagccagccttaatgcgtattttgcaatcactgaaggctcatactctttagccgcccgcaccacgatacttggataatcacccaaagcccgtaaaacatcccacgcagccggatcactcaaggctacttccggcgccggtgcaatgttggccttgcgcaagatgctgtgtgcccgggcattggtgtattgaacgtacggaccggtttcgccttcaaaacgaacgacttcctctaggttaaagtcaaagttatccagccgttcattcttcaaatcatggaaaataaccgccccgacaccaacttcatgggcaactttttctgcattcggtaaatccggatgtttctcatcaatttgctgctgggcaagtccgactgcatcttttaagactttttcaagcaaaatgatgttaccgcggcgggttgacaacttcttgccattggctgtgatcaagccgaatggaatgtggtgtatatcattggcccactcgtaacccatttccagcaagactgcttttaactgttggaaatgttcgcgctgctcgttacccacgacatagaggctctgcacaaaatgataatgttctttccggaaaatggctgctgctagatcacgggtcatataaagggtggcgccgtctgattttttgatcagcgccggattgaggttgtatttacttaagtctacaatctcggcaccttgactggtttttagcaaatgcttatcttccagggttttaaccacacgatccatcttgtcgttgtaaaacgcctcgccattatatgaatcaaaatcaacgccaagaattttatagattcggttaaactcagccagtgaaaccgtccggaaccaccgccatagcgtgattgcctctttgtcgccatcttccaatcgcttaaaccatgcccgcgcttcatcttccaactcaggatcggtttcagccacttcatggaacttaacgtaatactgcaacaggtttttaatcggatcagccttaacatcggcttccgatccccattttttataggcaacaatcagcttgccaaattgggttccccagtcacctaaatggttaattttaatcggcgagtaaccgaccttctgcaagatattagcaagtgcattcccaataaccgtcgaccgcaaatgccccattgacattggcttagcgatattagggctgctcatatcaatcggcacattgccttcaccaagcttagcatcgccaaaatgctcgccggattgggcaattgcttttaaaacttcatgggcaaaactgatcttgtctagataaaagttaacatacccgcccactgctttaacctgctcaaacggggacgcgtcaatctttgcaaccaaatcactggcaatcatcttcggggcctgatgcaagatctttgccaatgaaaacgttggaaaggcaaaatcgcctaaatcagatgacttgggtgtttcaactaacgcggtgatggccgcctcatctagctgaccatccaaaaccggaacaagcgctttaacaacaagttctttgaaatccataatttcctcctaaatcatgatgccacgaaaaaagacccatctctccctttacgaagagacgagcctgcacccgcggtaccactctgcttgacatgagtccactcaaaacactgatcctcaaaagcgcgccaacaggttagacgtgatcgtttgcactagccgatctcacttttaaacgtcaaataacctgaattcctctttctcaccggatctatacagcggtcgacgagaatcgaactcgcgacaccagcttgggaagctggagttttaccactaaactacgaccgcaaatcaacgcatataagtgtatcacggcgaagcaggtttgcaaagactcaagcggtacttttttctatgattttaatgagaaaacatcttaaaaatgagtacgggtaattttgttgttaatctttctcaccgtgttataataaaaagaaagaagaggagtggttgagatggcaaagacgggacgccactattattttgtggcgcgcaacgagaaaaccaaaactggttatcacattagttttcctaatattcctaatgctgaggcggtcgggacaacgtatgaggaaactgtttattattcatatcgcgttctggccgatttcctaagccatctgccaaagcaagaagctgaaatccgcgcttacacactctctgatattcccgacaccgtggcaagcaacgttttctactctttggttagcgtgacaccagacttcgatccccataaaatggaaacgcactttacgcttccgcaaacgccacccgccgacattcgtcaaaaagcggctaaacttgccggtctcgtgacccccaatgacaatttggctttgtaggcagacattagcatgcaagttattcgaattggacttttgattattttcattggtgcgagtgttctgactctgattggtttattaggctggctcattttaatactcagtcatcatcatccagaaaaaatgcggcgtttgacactaattagcggtggcattgcgttggcggcgttaatccttaatgccttcacctagcatgccggctgatcatgaatttgcatacaactcaaaacgttcctttaaacttcacgaacaggagtttaagggcgcttttttggttacgccggggtgagtgactggtttctgaggcttttctatgcttaaatgggaacagcaaatattgaaggagtgggcaagtttatgactgatctgcgtacaagtattgatggctttaaatttgacaatgtatttatgaatgcaagcggcgttcgctgttacaccgaacaagaattagacgaactggtgcaaagcgatgccggcaccttggttaccaaaagtgcaacccaagcaaagcggctaggtaacccgagtccacgctatgcccgtctggaactaggctcaatcaattccatgggcttacctaacgaaggcttggattactacctcaactacgccttgaattttcaaaaagcgcaccctgatcagcccattttcatttcagttgccggtttgtcgatggaagaaaatctggcgatggcacacacgattgaagattcggattttaacggtttggttgaatttaatctcagttgccccaatgtgccaggtaagccgcaaaccggttatgattttgaccgtacgcaagaagttttgactaacctgtttagcttcttcactaagccagccggggtcaagttgccgccttatttcgatttggctcagtttgaccaaatggcagctattttaaatcagttcccgttgaaatttgtcaactccatcaatagtctgggtaacggtttgatgatcgatccagaaaccgatactgttttaatcaaaccaaaaggcggtttcggtggtgtcggcggtgcttatgctaagccaatcgcccttgccaacgttcgcgcttttgcccaacgacttaacccgcaaattcagatcatcggcaccggcggcatcaccaatggccgcgatgcttatgacttaatccttgccggtgctagtctggttcaagtcggtaccctcttacaagaagaagggccagcggtgttcacccgcctcaaacgagagctagcggcggttatgcagacaaaaggctacactcaaattagtgacttcaaaggacaactcaaaaccttatcatgaataaaaaaatcaaagtctggtctttgtttacccgaaacaccaaagactttgcccatcactggggcgcctactttctactgatcagcgtaaccaatctcgcagtcggactggcaatcatcccgctgctgacttttagtgcgcaacaaatcctgcgtctaggaaatgttccctacatcactttaaccaacttaggcacgattatcgtggaaaagccaggtaccgccgtcttactcttgctaattggcttactattactgctgttcgtctattggcagtttgcgtttctaattctcggcattcaaaacatccaccgccaaacgcatttaaattttcgccagttagctttagcaacgatcaaaaagacccgccgcttgacgcccacaaccattatgattttgattgcctattttgttttggtttttccgttctcaagtatcgtgtttaaaaccagtttattggccaaattgacgattcccgatttcatcattgatttcattttggaccgctggtatttggcaattctggttgttttgttatatctggttggcacctggttggctgtgcgcctattaccacttttgccagctttaatccttggtgatgagcatcccgcagcaacggttgttcgcagctggcgagcaacacgcggtcaggcttggcgaacactcttttcaatcatcctcattgtcattccggtgatggtactgacggtgttgctgatccttggattatatgggtttcagacatacctagaccagcaatggcagcagtggtcattattaggtgcaaccattaatcttggtttattgcaggtcacacttttgctgatcacggttttctttactgtcatgctgtatcaattagcaaccgcccaagcagaaacttttcaactcatttccgtgcaaacgattgatgcgccagtgtcgaaacggcggcggacggtactttttcgtctcagtgctttggcgctaattttgctggttgtcgctagcaccagtgctttttaccacgcttatctaaccggagccttaacgacccagccattaaccatctcacatcgcggagttgacaacggaaatggcgtgcagaatacgatcccggcgttggaagccactgctaaggaaaagcccgattatgtcgaaatggatttgcacgaaaccaaagatcaccaatttgttgtgatgcacgatgaaaatctaagcgcattaaccggacgtaatgctcggccgcatgatttaactttggctgaactaacacagctaaccgcgcgtgaaactgggcacgccgccaaagtcgctagtttcgatgactatctggccgccgctgaagcagcccatcagaaattattggttgaaattaaaacaaccccctatgacagcccagaaatgatggatcgttttatccagcgatatgcgcaacgcttattggcagatcatgatcaagttcattcgctcgactatcatgtggtcaccactctgcgtaagaaggtcccgacactcaagacgttctttattctgccatatacactggtttcccctgcaacgccagcaagcggttatacgttagaatcaaccaccctttcaacgaccgtgactgatcaagcccatgcacggcatcaggcgatttatgcatggaccgtcaacgatagcgatgatatgcagaaaatgacgtttatggatgcagatgggattatcactgaccaactggcaacacttaagacgaccttacgtcagatgaacgatcaccctagttatgccgatcagctgctgaattacatgaccagtttctcctctggggataatagtccgttttaaatgattcgcgtcatgttttcagagatgctaagtttaagaacacgaaaaaatccactcatttgagcgggttttttaaaccatctttacttaaagtaataccgcgctgtttctaatgcgctggtttccatcaatcgtttgccgtactccgacaaaaccgcagatgacaacggtgaccgatcaccaaattccagtgcgactgccatttcatcgtgcgcttcattagatgaaatttcgtttggatagaaagtcaaaacaaggtagtagttttgcttgtaacgataaagatcactcttaccgccttccaagcgaagcgtctgagcaaggctgatgaaatcttcaaaatcctttaattttaagactaattcggtttgtggtgctttggcagcatcaatataaccgccttcgtcaacagcttgctgatcatgttgatcgttggcatctaacccctgcagctgctggcgaatataatccggcacctgggtatccgcactatcaccatcagaaccggtgtcgctatcatcattcttttgtccgttcttactgatcaacaactcgagtccggactgacttggcatgacttgaaacgtcacggcctcatttgtcgcaaacgtatgatctttatcgacttcatcgaggatactgtagaagaagctttcaatctgcttgtgattaccaagcaaatccagcacggtaattccccgctgcgctagatcatcgttgcctaacatgacccggatcgtatttgcgttaatccgttccatttccatgattgctgcacctcactttagtcacggaaccctgacttttgtggttcatcacatgaccacttactacattatagcagatttcgtacttcacggcattctaccgcacgtacctgttatgatcaagtcgcaggctttgaaatcttaaaatcgcacacattttgtacgcaaaaagaactgcctcggcgatccattgtgccaaggcagttcttttaattgcgcctgttgcaattccaaagtccgaacagatcgtggcaagaagcggcggatttcgtcctcgttatagccaacctgaaggcgtttgtcatccatcatgatcggtcgccgtaacagacctggatatttcgccactaacttaatcagggtacccgttgacagttcatcaatattaacgccgagctcctggaagatctttgaacgtgttgaaataatttcttcagttccttcttcggtcatcatcaataaccgtttgatttcatcaacattcaatggatcagaaaaaatatttctttcttggaatggaatcttattttcctttaaccaggcgcgcgccttccgacaagatgtgcaacttggggatgtatataaaataaccatgagcgctcgctccttttctttgacgaggtatctttctcaactacaggtatagtatacgagattgcctcaaagcggcgcaatcacatttagaaaaataatttttcaaatgatgaaaatttcgcgttcaaagtcttgatattgcgtgatctatcaacgtctttataagtttaattgtaataaataccccaagttataataactaaatttttaacattttcctctcattttaaacgatcagttatcatcactatcagacattaattgtcaagtcatccctggcaacgtcaattggtatacctcccgctactgcttgtgcctgatccttcaaagtgacaagatctagctgttggggcaaatgcgttaagagtgaacgcttcacctgcgcttcttttgctaacgttccggcttctggagcggtcaaatgccatcgtggcgctggttgatcggcaaggaaattggtatctgccatcaacaggtcagcgtgcttagcaaagggaaccaatccagaaaaatagcgcgtatcactcgtattcacaagtactttgttggtgccttcttctttaatccgtaccgcaaacgccggaacaggatgctgtgtctccaggaaggttaacgtaagcggccctaaatgtaaggtgctgtctccggtataaccgatcccttgcgtaaacggaccaaacgttaagctcccaaagttcaaaggatcctttgtgtgcccgtaaattggcaatggcgacacttttttgtttcccttgcgtagttgatagaagtactgcaaaacgccgacatccgccgtatgatcatgatgatagtgcgtcaacaaaaccgcgtccaattgcaatgggtcaaagaccttttccaatgccagcaaaccgccactacctaaatccatcagtaagtgatagtcgccactttcaattaaataagtactcgttgcatgtccggcatccggatagccgccgagataacctaaaactgttaatttcatttagtttttcctccttttcaaagtgaaatgctgccaagaagtttataataaaagtggaggtggtcgttatgtccacaatacaaacggttttcggcagcaagtcttttctgactaaattgcttgatgaacgccatgatccgcaactaaaactcttgaaaccagcacaaagcggtctagactatatgattttcgatcccagcggtcaagccacattcagtgctcccctacgctatgaaattttagctagcctagggaaaaccgagcaaagcggctatgtgcatttcatgtactttaaccttgatacggatgacgtcaaagtcttcttatccaaaattaaacaactgatcgataatcatgatattttgttgggcgaaaatcatattttactagcgcaggaagccaaacatccggacaatttcctggtgatgtcagtctggcaaacgagcaatgactattacgaattcaagaatacgccggcactcgcatcagtcaaggaattcattcgccgcgctgcctctgccaatggttttcatgaggccggttatgccgtgatcgacccgcacaaaaagtgacagtgtcaaccgccaaatcattttcgtagcggttgctgcatttgattgggatgaaaaatttaaacctgcaccaagctactcgacaccagaagtttgccaccaagattcagcgtccggctttacaggctgggttttggcgattcaaacatgctggtgtttttccatgccggaaattcattcagttcgccaccgcccaatcggtgaatcgaccatgcgaaccatcacatgaacggttgcttcgtaaaagagccagtcaaatgctgcataaatgccaatcatgacgcctaaatagcgcgagggtggattatcaagataattggtcatcacactaatgacacataaggcgatcaaaataccgcagatgagcggaacagcaaaaataactgcagcctggcgataaagcgtgacccgaatctgatggggatccatccctaactgtttcagaatctgaaaatggcgaatttcctgccgcaccgcgatcacttgcttcaacaacaagatgcttccggttgccacgacgaatacaccgctaagcaataagatcaaaaatagtaagaacccatataaggtactgacgaaattctgctcggccgcctgaagaccaatggggttacgccaatataccatgttggtgctcgctcgatccgtcaccgttaaatcatcgccttcacgctgttgtatgccaatattaacaaactcttccagatttttactgttgcccaaatgctgcagcaaggtaagtgcgcgtttggcagcttttgtttttggcaacttagccatatacaagcgatccggcgtcccattcaacatatcaaaggttcgattggtcaccaacagaccacggtcaaaataattattgcttccggttggaaaacgattggtcgtctgcgtcagacgtaacgatgtatcactgccaggcaggataatggcgcggttcggattacgtctggcgccaactggccgaaagccgcttctggtcggaagcatcaacttagcctcttgtgaatgcaaccgaatcggtcctaattcccgttgaatcttagccgcgcgctggtaatcacgtaacgcaaccacattgtagacccccggctgtttacgcacttcaccaatctgattacggagacgaatttcagcataaaccagctttgagggaatcgtcatcgcctgcttcggtttgacttttgcctgtttcaaaatatcggtcacattatcaacaccgacacctgatgcgactatggttgtcggaatctcacgtaaaaccaaatcctgattatattgaaaaagcatgactgaactacctagcatggtaatggtgatcgcacacagcaacgtggttaaccacaacgaatgagcattcccctgcagacgcttaataatcagatgtcgggaaataccgctcgcattatgggtttgcatctcgtgccgtttttgataccacgctaccagtcccggcaggaaataagcaaaaaccaaaaacaacccaagcaataaggcgccgattaccaacaataaaaagagcggtaacacaatcggtcccgggagccaggagagtatgcgcatcaagcgaccgccaattggaagcaaacgcaacatcgtcaacaaactgccgaccaacaacaaaaagccaaaaataccgacccagaagcgccagcgggtttgcggttttggtggtgccgggacatcttgctggcgaataaactggcgtaacggactgcgaacataaatcgcattgatcgcaccgactaaaagataaacaactcccatcaacgtcaagacgtccattaatgcggacaaagaaaacataaagccgatgggtgtgtgcaatgccattaaccggatcaacaccatccctagcaatggcgataaaatcaagccaagcaaagccccgacaaacagacccactatgccgatcatcacactttcaagaaagacaatcagcccaagtttggcgcctgataatcctaaaagacggtataagccaatttcctgatcacgccggccaattaacagactattcaaataaagcaggaaactgattgaaaaaagtgccaacaccatcatgacaatcatcaacaggctcgggacaatatccaagttaccaagtcgcttactggcatcacttaaaattaaccgattattggcaactgcaccgatcgcgtacataatcgcactaatcaaggcagcaatcagtatctgtaggccgtcctcgtgccgatgccgaatcagattcgttttaatctgttcccacacgtgaatggcctcccccactaacggtcgcttccatatcaatgatgcgatcaaaaaattgttctcgcgacttaccacgcgttacttcggcaaaaaaggccccatctttaataaaaataatccgactcgcaaaactagccgtaaacggatcatgcgtgaccattaaaatagtcgttttctcttgctgattcaactggcgtaaataacgcaaaaattctgttgctgccagcgaatcaaggctgccagtcggctcatcggctagcaacagactgggttgtgtaatcacggcacgcgctgctgctacccgttgccgctgccccatactaagctcacccggaaaagcgttcaacaaagcatccagattaaggtgttttgacaccatttgtaaccgttcggcccggtcaggctgcacatgatgttgcaacgtcagtggtaacaagacattttgggcaaccgtcatatcatctagtaaattaaagtcttgaaaaacaaaaccaaggtgatcacggcgaaacttagcttgctgccgttcattaagcgcctctagatcatggccggcaatcctaaccttccccgtacttggcgtttcaatagttgccaaaatgttcaaaagggttgatttgcccgcaccactaggacccatgatgccaataaactcacctgccttaacctgaaagctaagatcgtttaaggcccgaacccgatcgtggcgctggccgaaaatcttacttaaattagatacttccaaaattgccatgggcttacctccgtcatcatcataccaaaaaccgccacattcaacatgccagtgcgactatcaagctttctaaacgggacaggttaaaggcatcagaaaaagttccgagaacttttcaccataatacgcttatgttctaagttacgcccatagcgcgctcaccggcgcagggatctgcgtgtaaggaccttggtcgcaatggccaaggccacttatgttctaacttacgcccataacgcgctcaccggcgcagaaacctgcgtgtaaggaccttaagcgcaatggccaaaacccggccatcacgcctgaggccacttatgttctgtcttacgcccataacgcgctccccggcgcagaagtctgcgtgtaaggaccttaaacgcaatggccaaaacccggccatcacgcttaaggccacttatgttctgtcttacgcccataacgcgctccccggcgcagaagtctgcgtgtaaggaccttaaacgcaatggccaaaacccggccatcacgcttaaggccacttatgttctgtcttacgcccataacgcgctccccggcgcagaagtctgcgtgtaaggaccttaagcgcaatggccaaagcccggccatcacgcttaaggccacttacactccgacttctaagcgcgccggctcgcgctcacttttgtttgtgtctcggccacaaaacttgtacgataagttcaggaatggagttggtcgcgtgtttaaaatcatgattgtagaagatgatcagacaattagcggtcttatcgctgacaacctcaagaagtggcagtttgagcctgtcgttgtgactgattttaacgctgtcttcgatgattttctgcaggaaaaaccacatttagtcttattagatatcaatttgccggtttttgacggctattattgggtccaaaagattcgtgaagtttcaaaggtgccggttattttcatctcaagtcgcaacaccaatatggatatggtgatggcaatgaacatgggtgcagacgactttttgaataaacctttcgcgatggaagtcctcatcgcaaagatcaatgcgctgttgcggcgaacttataattatgccgatcaaggaaccgatgtccttgaacacaatggactcatgctgaatctaaaaaacggtatggcccaaattggcgaaaaggaaatcaatctgtcgaagaacgaatataaattacttcaaattctgatgcggcaacatggccaaattgtcagccggtcaagacttttgcgcgacctctggcaagatgaacgctttgtggacgataacacgctcacggtcaacgttaaccgcttgcgtaagaaaatcgaagaagcaggattgaaagattacattcagactaaagtcggtcaaggctatattgttccctaggaggcagccatgcgttttcgcgactattttaaagaccatatttgggcgattggcggctatattttatgcgtcggtttagctgccatcatcgtttggctggatccgcaacaccgcgttaaattggcaacggtctggtatgcggtcttactcgtcacgttggttgcaattgccttctttatcgcccattttgtccgtattcgccagtttgctgctcgcttgcaggcgcgccagaatgctgaagatgctgctttggattggccgctaccagggggtcaatccggactggaacaggttgtctcggatacttacaacaaaattctgaccttgcatcggcaacaaattaccgcgcttttggctcaacatcaagaccaaaaagatttcattgactcgtgggtacacgaaattaaagtaccgttggccgcggtttcattgcttgctgaaagttttgagggccaagttcccgatgacaagctggataacctcaatttacaactggatcaaatcgagttttatgttgagcaggtcttatactattcccgacttgacagcttttcgaaagattacttgctgcataatacgcaattgaaaccgctgattaatgacgttgttgccaatcaacgtaatggcttcattaacaaacgtctgtcatttaaactgaacggcgatgaccaaaccgtcttaacggacaataaatggctgcggtttattttgacgcagctcatttccaatgcagtcaagtataccccagaaggtgggcgcatccaggcaaccattcgcgacaccggcaaggaaacccagctgatgatcatcgacaacggcatcggcattcctaaagacgagcaacaccgcgtttttgaaaaaggctttaccggcagcaatggacgcctgtcaaatcataaatcgactggtttgggattattcttagcagaaaagttggccgaaaagttagggcatcacttaacgttgacgtccgtgatcaatcaaggcacaacggttaccattcattttccatatgtcagctattacaatgatgctggtcaaaccgttgaacatcccaaaaaggcacttcatcaaacagcagatacatctgattcatccaaccaaaatgagtaggacattcttctttaacgaataaagcgagtagctaagcacacgaccgtcattgttgtcttgtggctagctactcgcttttttatctgtctatattttgtttgcagcaaagaacccaaccaccagcggctgcgactttaatcagggtcaaacttttatcgaatgaggtttttccaaagcttgatctcacccgccgcctgggttgccggcacatcaataatccgttggttggaactgccgcgaaattgcagcgttaagtctttttttgccaacaggaagcgcccatccaccaatatatcgatgaggctcagcagcgttaacttgtcttcggaatcctgcatgagttcttcgtaagtgtaaccactccaactccagatatccttatcatgcccaaactcttggcgaatccggcggcaaagacgaatgcagacctgagtattcaaaaaaggttctccgcctagcagggtcaagccttgaacatatgactgagccagatccgcaataatccgatcttccagttcctgagtgtatggctgaccataccgaaaattctgggcgacacgattgtaacaacccgggcaagcaaagcgacagcccgagacatataaactacaccgaaccccttccccatcaacaaaattaaacggcttgtaatcagcaattcgttgttgtgaaagttcactagcaagccattctttcggttgtggattctgcggtaaacgagctgtggtcatcataagatctgcctttcttaacaggttgcgttagtcaggttaaaacgcagccgtgcgtgttcttgattcaatcaacgcttcaaaaatgaacgccaacgaataagtctttttcatcgtatcatcttttgactacaagatgtagtatcgattgtgcacaaaataccggcctattatctatatcttgataacaggccggtatggatgctgtttttaaatacgattacgcgcgcttcaaatgcagtgtcatggcatttaacgccaccacgatggttgataacgacataatcgcggcaccaacagccgggctgagaatgaagccaactggtgctaaaatgcctgctgccagtggaatagccaggatgttgtagccggcaccccaccaaagattctgaaccattttacgattggttgctttagccaaagataagaagttaagaatatcggctggatcactatgaaccaacacaacatcggcagtatcaatggccacgtcggttccggcaccaatggcgactccgatatccgcttgcgctagactaggagcatcattaaccccatcgccgaccatcatcacaacgccacgtttttgataagcttcgacttgcgccactttgtcttcaggttttaattcggcttgaaaatcagtgatgccgagttgatcggccacttttttggcggtttcgtggttatcaccagtcagcatgaccggtgtaattccttgctgcttcaacgcggtgacaaacgacttgcttgacggcttcagctgatcgccttctgcaaccatccctagaacttgatcatcctggatcagaaaagccagtgagttaccggcccccgctaattgatcagcctgcgcttcatcataagccaagtgatgatcttttagataccgggcattgacgatcgtgtaacgttggccatcgatttcgccttccagaccgatgccttttaagacttgaacgttttgcgcatccggcagctttaacgcctgttgcttggcggcagctttaatcccggttgccagcgggtgttcggaatgattttccaaagcagccatgacagacagtacctgcgtttgatcgtgaccggcaaaggcaatggttttggcaacggtgaatttgccttctgtcaacgttccggttttgtccatcaagataaactgcgcccgcttgacagtctcaagtgcctggcgattacgaattaacagtccattggttgcgccaatactggtactgcgtgcaatgaccagcggaattgctaacccaagtgcatggggacaagcaatgataaagacagtgaccattcgttcaaacgccactgccgccccgcttggcaaccacaggaagaaagcaagtaacccaactgccaatgcggcgtagaaaagccagccggccactttatctgccataccctcggctttacttttattggcttgcgcactttgaactaacttcatgacttgcgacagatagccgctttcgcccgtaccggtgaccttgatttcaatgacgccatcaccattgacggaaccgccaatcacctggtcaccttcagccttgcgaatggctttagcttccccagtcactaatgattcgttgacactgctattgccactgaccacttgaccatcagccggcatttgttcacctgctaatacccgtaagcgcgcgccaacctggacttctgataatggcatgtccatcacgtgatcaccatgaaccacatgtgcctgattcggcaataacgccgccaacttctcaaccgcgttacctgcagccataacggcattcatttcgatccaatggccaagcagcatgatcacgatcagtgttgctaattcccaaaagaagtccatgaccatcccattaggcgcaataaagttattcatcaaaaacgcataaagcgaataaccatacgccaccgtgatgcccatcgcgatcaacgtcatcatcgccggttgtcgctgttgcaattctgcctttgcgccggtcaaaaacggccagccgccatagaaaaacagaaaagacgacaaaacaagaacgacccaatcagaccccggaaagacaatcggcaattcaatgaccccgagatgaatattcatgcccataaactgcgccaataacagcacggggatcatgacaatgaggctgacccaaaacttctgcttcaaattgcccatatgcatcatatgcccaccaccatgatccatattgccatgatccatgtgcatatccataccactgtgattcatcgccatatgacccatatcgtggtgactcatttgcatagatgccatatccgtttgctgatgcatatgttcgtggtccattgacatatccgtcattttcccggcatgcatctggtcgtgatgactcatttgcatctgtcctttgtcattagctgattctttcattttttgtgaagggttcatattatctttcttcatcaattgcctccttgcagccgtctggtaagcagttacaatgaaccgttgtcggtgcaccaggcaatttagccgccaaagtttgctgcactgcttgaatatctttcttggaaagcgtcacttgcgctaccaaatgattcacggtcgtaccgatcttcatctgacaaagatgactaaataactcctcaacggctgcatccattgaggcttgctcaccaactgttgcatgatataaaaattcgcgcccttgcttttcagtgaccagcgcaccctttttgacgagtcttcccaaaaaggtcttggtggtcgctatcttccacgccattttatccgcaagaatcgccgcaatggtgctgctttttaatggtccaagcgtccaaataattcgcataacctcccattccgactgggagatttcaactttcggtgtttccatcatcggcctccgtttacacttgtaatctttctacacttataatttacaactgtaaacgatgattgtcaactcatgattaaactatttatgaaaataggccgcttaagtgccaagtctggccctaactgttctctgcaaataaacaagcaccgaagacgatggcattggtcttcggtgcttgtttatttgctttttacataaaactagcggcagttatcccttcaaggcatgaaagccgatatcggtccgataatccagcaccccttgaatactttccaagtcatgcttggctttggcaactgcctcaggtaaggtaacagccccagcaacaaccgaaaaaattctcccggcgtcactgatccaaccattgtcggttcgctctacccctgctggcagccaagtaccgattggccaatttgttggcacaatgacgggaacggttttcagatttgcccgcggataatcgggatttaccgcgacaaaacaggcataggcttggccattcaatttcagcgttggctgctggccatccaacaagtcgctcacaagctgataaaagtcattttcgatctgtggcaataatacctgagtttcaggatcaccgaaacgcatgttatattcaagaatcttgggtccctctttagtgaagatcagcccaatatacataaccccgtgtccatttaaaccatcttggtgcatgcctgccaatgtggcatccaccaaggactgggccgcctggacttgatcgggcttaaattgtggcaacggactaatcgcacccattccacctgtgttaggtccacgatcagcagcgtggcgccgtttgtgatcctgggacaacggcaagatcacgcgcttttggtcattaaaaagtgccatgacggaagcttcttcgccagcgagatattcctcaagcaaaaccgtggcatccgggtggccggcgtaaaactgttcgatcgtatcatcaagtgtcgctgcatcattggcaatgacaacacctttaccagcggccaagccatcttttttcagaacaagcggtaaacccatcaaagttgcttcggcatgtgcttcaatcgcactgtgaaccgtcttgctggccgcggttggtaaatgatggcgatgcataaacgctttggcgaaagttttactcgattcaagttgggctaatttttgcgtgacgccaaagatcggcaacccgattgcttgaaaatcatcaacaatccctgctgccaaggggacttcaggaccgacaaacgtcaaatcaatctgatgcgtttgcgcgaacttgattaaagccgggacctctttttctttaataccaatcggctcaacaccaagcaactccatcgccggattgcccggcgccacatagacatgatccacttgtggcgactgactaaatttcaaagcaagggcactttcacgcgcacccccaccgataaccaggacttttttcataaaaacctcctaaaaaagtgagcgtgaaccggcgcgcttaggagtcggagtgtaagcggccttggacgtgatgacccgggcttggtcattgcgcccaaggttcttacacgcagactcctgcgccggagaacgcgttatggtgaacgtgaaccggctcccgcctaatgccggaaatgccgaacccctgttgtcaccatcgcaatgccatattcattggccttcgcaattgaatccttatcccgaatgctgccgcctggttgaataatcgccttaatatcatgtttagccgcgtaatccacgcaatcatccatcgggaaaaaggcatcgctagccatgaccgcaccggcaaagttgtcgttttgctgggcttgggttaacgccaattcaaccgagccaatccgattcatttgaccggcgccaatccctaacgtctgatcagcctgtgccacgacaatcgcattactcttaacatgtttgaccaccgtctgcgcaaatgccaatgccttaagttgagcttcagtcggcttgacctccgtcaccaccgtcatatcggctggtgtctcagctttgtcgtcacgtgtttgaatcaacaacccaccataaattgaagtcgtttctgttcccaattcttctggcgtatcagcagtattaatcgtcaataagcgcacatttttcttcttcgccagaatctcataggcatcatcatcaaatgccggtgccatgatgatttcaaggaaaagtttatgcattttctcggcagtggcaagatcaacccgccgattcaaagcaatgatgccgccaaaaatggacatcggatcggcggcatatgccttgtcccaagcggcttcaagcgtatcgcccaagccaatgccgcatgggttcatatgtttaacggccacggctgccggttgtttgaattcccgcaacattgccaatgctgcatccgcatccttgatattgttataagaaagctctttaccgtgtaattgcttagcagcggcaagactggttggatcaggattcggctcaacataaaaggcagcttgttggtggctgttttccccgtaacgcaagtcctgccgtttgtgataagttggcgtgaattgctctggaaatggctctggatctaagtaatgggcgatttgagcatcgtaagcggcagtgacggaaaagactttggctgccaaccgttgccgtaaatcagcatcattttgatcgagtccggctaaaacatccgcataatctgccggatcaaccacggcccagacactgtcactatttttagctgccgcacgtaacgcagacgggccaccaatatcaatttgttcaatcgcttcggcacgcgtcacacccgcacgctgaatggtcgcggcaaacggataaagattgacacaaaccacatcaattggctgaatatcatgatctgccaatgcctgcatatgggcaggatcatcccgccgcgccaagatgccggcatggatcttaggatgcagtgtcttaactcgaccatcgagcatttctggaaaaccggttactgcttctacgccggtcaccgcaaccccagcttcagccagtgcgcgatgggtaccaccggttgaaatcagttcaaaaccgcgttcaaccagaccttttgcaaaaggtaccaaaccagttttatcagagacacttaataatgcacgcttcacttaaatcgctccttcttcaatgagttgcttgacagttgcgggaaaagtttgatgttcctgatggtgaatggctgcttctaattgtgccagcgtcatccccgggcttacgcggaccggatcctgtgcgatgatttcgccggtgtcgattccggcatctacgtaatgaaccgtcacgccggtcactttgacgccataatcaaatgcatctttaatgccctgccgcccgggaaaactaggcagcagcgcgggatgcaaattgataattcgcttgggaaaagcatttagcaaggttggcccgatgatccgcatataacccgctaaaatcaatgcatctacaggcggcaactggcttaaaatataagtttcggccgccgctttattcgcatagtccttaaagttcacaactaaagtcggaatatgacgagcagccgctttttgaatcaccggtgcttgcacttgatcacagactaagaccgcaatttgatagtgactgtctgcagcctgcgcggcgtttgccaaggcttcaaaatttgtgccatttccggacgcaaagacagctagacttttcatttgcttgccacctgccattgtattttggcgcttggatcagcaaccacgcgaccgataactttactgcttggtaacgccgcctgaatcgttgtggctgcatgttcagggacgaccaaaatcatcccgatgcccaagttaaacgttgtccgcatcgtggtttcactcaaatgcccggcatattgcaggcgatcaaataactccggtcgatgccatgcctgggggttaatctgcgcacacaatcctgccggtatcacccgcggcaggttctcggtaataccgccgccggtaatatgcgctgcggcgtggatcaaaccttgttgcatgagcggcagcacctgcttaacgtaaattctagttggccgcatcaacgcttgcatcacttccgatccgtcttcaagtgtctgactgcccagatcggtttcagctaacaatttacgcaccagcgagtaaccattgctgtgtacgcctgaacttggcaagccaatcaagacatcaccagcagccacgtccttaggtaaacgattcggttcggaaaccaaaccaaccgcaaacccggccagatcataatgattttgtgggtacatatccggcatctcagcggtttccccaccgatcaacgccatttccgcctgctgacagccataagcaatcccacgaacaaccgcctcggcccgggtcacatcaagatgatcaacggccatataatcaaggaaaaacaatggctgggcaccggatgcgagcaaatcattggccaccattgcgaccaaatcaatccccaccgtttcatgcgcatcacattgcagtgccaacaacagtttggtaccaaccccgtctgttgcactaatcaaggttggctgcggcacggatggcaaccgataagcggcagcaaaaccgccaacactggccaaaacattgtcattggctgtttctttggctaacgtcgcaatacgttttacggctgcatcgccggcttcaatgtcgacgccggcatccttataatctgtcatgcgctaacctccgctacattaactttgagtgatgcgacttccttatttaacgccggtgcataatcatcaagagcagttggatatttgcctgtaaagtaggcgacacataaaccgccattaggagccgtcgttggcaatcccacgctgtcttccaatccttgcgtcgaaagaaaacctagcgattcgacatccagtaaatcacgcatttccggtacgctatgattagccgcaaataattcactggttgtctgaaaatcaatcccataaaagcaaggaaagcgcaacggcgggctggcaattcgcaaatgcacttcagcggcgccggcttcttttaacaatttaacaatttgtttagaagtcgtgccgcgaacaatcgagtcatcaactaacacaatgcgttttccggcaacaaccggtttgatcacactgagtttcattttgacgcttttttcgcgtaacgcctgcgtgggttggataaatgtccgagcaacgtactgactcttcaccaagcccatttcataaggaattccgctggctttggcataaccaattgctgctgacagggatgagttgggcaccccaacgacaatatccgcatctgccggctgttcccttgccaaccgctcacccatccgcacccgcgcctggtgaacattgatgccgtggatgtctgaatccggacgggcaaaatagatatactccatcgagcaaaccgctaacgatgtgttggtggtgaagtgatccaaatgcaagccatcgtcatcgatcgtaatcagctcaccgggttggacgtcacggacaaaatcagcccctactgcatccaacgccgcggtttcgctacaaacaatatagccgccatctggcatgatcccaaccaccattggccggaaaccatgcggatcaaccgctgcgtataagccatgctcggttaacaagacaaaggcgaacccgccgtgaacctcattcagtgcctttttaagttgaaccagccacggttggccaacctgacgccgaatcaaatgcattaaaacctcagtgtccgaggtggattggaaaatcgccccttgactttctaactcacgccgcagactgatggcgttggttaaattgccgttatgcgctaatgcaatggcttcatcggaaaaccgaaaaagcaatggctgaatattttccaagacccggccacctgctgtcgagtagcgcacgtgacccaaagctgcccgccccatcaacggtgtcaattgatcggtattggtgaacacttcactgagcaagcccagaccataatggcgccgcataccatctttagttaagccgacaattccggccccttcttgcccgcgatgttgcaacgtatgcaagcccagatgggtaatgctcgcagcattgggattgccccaaataccaaaaacaccgcattcttcatttaagccttttggttcagatagcatgggagtgcctcctcaaatgcagtttgcaattcttcaagcggaatcgaaaattgatgactaaccgtggtgacgtcaaattgcggggctgcttgtacccgcccgattaactcagccggtccattcagcgcctcaaacgctgcttgatcttcgggagcaacggtaactaagaagcgcccttgagtctcggaaaagccccaactcgtcggcaaatcgaccttaacttgcgcgcccagctggttcgtaaagcccatttcagccaacgccactaacaagccgccatcgcttaaatcgtgggctgctgtcacaaagtgttgccgaatcgccgttaatacaaattgctgattggccttttccgcatcgagatcaaagtcgaataaccgcccggcaacttcaccggtttgcaatttctgtaattcgctgccattgaaatcgccatgggtttcgccgacaagataaagcaaatcatctgcatgtttgaaattcgccgtggtaatggtgctgagatcttcaatcagccccaccatcccaatcatcggcgttggatagattgctttgccattagtctcgttataaagcgaaacatttccggaaatcaccggcgcgttaaaggctttagttgcagcaatgatgcctttagccgcttcggcaagttcataaaacgcttccggcttggttggatccccaaaattcaggcagtcggtaatccctaaaggttccgcaccgctggccgccagattgcgcgccgcttcggcaacactcatggccgcaccgacttttggatccaaatacagataacggcctttgctatcggtagtcatggcaagagcgcgatgggtcccgcgaatgcgaatcaccgcggcatcgctaccaggcaagacaaccgtattcgtttggacttgtgcatcataacgccgatacaatgaggacttatccgcaatcgtcggcgtgcccatcatggctttccaagtcgccaccggatcggtcacgatcgggtcaaaatcaggtgccggttcagctaagcgcgctggcattttaccgacttgctcataaatcggtgcatcatcagtcaatgaactgaccggaacatcgcaaaccaatttgccgtgatgataaagccgatattgatggccttcaatcacatgtcccacaactgcagcgtccaaatcatacgctgcaaaaacatcaaggacttcctgttcaaaaccggcccgcacacacagcaacatccgttcctgtgattctgataacatgatttcaaatggtgtcatattggcttcacgctgcggaattaagtcaagatccatttccataccgctattcgccttgccagccatttcaacgctggaagacactaaaccagccgcgcccatgtcctgaataccgactagcgcctgctgatgatcctgcgtaatttccagacacgcatccatcaacagcttctccatgaatgggtcgcctacctgaaccgccgaacgatcagccgcctcttcatcggaaaaatcaccggatgcaaaactggcaccattgataccatcacgcccggttttggcaccgacataaatcagcgcattaccgactcccgccgctttgcctttttggatctgatccttatccataatgccgacacacatcgcattgaccagcggattgcgggcataggtatgatcaaaattggtttctccgccgaccgtgggaatgccgattgcgttcccataaccaccgataccggccacgatgcgatcaactaaatgctgcgtgtgcgggaggttgagatcaccaaacgccaatgaatccagcatggcaaccggcttagccccaattgagaaaatgtcccggataatgccgcccacacccgtcgctgcgccttcataaggttcaaccgcggacggatggttatgactttcggctttgaataccactgccttgccttcgccgatatcaattacaccggcaccttcgccaggtcccatcaaaacgcggtcatttttggtccagaactggcgcaaaatcggtttactgtatttatacgcacagtgttcactccacatgccgcttgctaatccgatttcggtatcatttggctgatgaccaatcaactcagcaaaccggtgatactcatcttccgtcaatcccaaagccaaatacggtttcttttcagcgatggcttctggactcatctcaacgtgcgtcacggacatggacccctttcgtttgttgcatcaatgacttgaaaacgcctaggccatccgtaccgccaagtagtgcttcaacggcgcgttccggatgcggcatcatgcctaaaacattaccggcttcgttcgtcaccccggcaatatcatgaagactgccattgggattgtcagcataccggaaaacgacctgaccattggcttccaaagctgccagcgtcttgggatcagcgtaataatttccttcaccatgtgcaatcggcaatgtcagttgttcaccaacctgatattgattggaaaatgctgtatccgcgcgatcgacaagcaacgtcaccggttcgcaaatgaagttcaaatcccgattccattgcaaagcgcccggcaacaaacccgcttccgtcagaatctgaaagccattacaaatgcccagcacatagccacctgcttcggcaaaagctttcaacgccgtcatcactggcgaaaaccgggcaatcgcaccgctacgtaaatagtcgccgtaagaaaaaccacctggcaccatcaccacatcataacgacttaaatcggtttgactcggcttgatcagctcgcactcagcaccggcaatggtctgaacggcccactgtaaatccaagtcacaattagatccgggaaaagaaataacggccgctttcatgcctcatcctccgtaatgggttctaattcaaagcgataagtttccatgttgacattggcaagcaactgatcgcaaatcgtgtcgacctgcttttctaccgcttctttggtgccagttagctttaattcaaagtatttgccgtataacacgtcgcctacattgtgataatccatgcgggttaaagcagtcttgataacttctgcctttgggtctaatacagagggtttgtacgtcacataaactttagctttaaacatgagccgctcctttttcttgtaatctggaaagcacttcttcataaacaggggttaagggaccgcgcgcttggcggaaaacatctttatcaagcgaatcaccggtcttttgatcaaccagacggaaattatccggcgacaattcatcggctaagaccaaagtaccatccgttaacgtgccatattcaagcttaaaatcaaccaacgtgatcccgacctcatcaaaacgcttggtcagataagcattcacgcgatcagtcaaagcccgaacttgtttgagctgttccggggtcgcttcgtgtaaagcaaaaatctgagcttcgttcatgaacggatcgcctaattcatccgacttgtaataatattcatgaattggcggatcaagcttcatcatcggcttgacattgaacttagtcacaaaatgtccggacgcgtaattgcgcaccacgacttctaacggcagcatggtcgcctttttaacaatcatggtggtggcatcgggagaatcaatataatgcgtaggaattccggctgccgtcaattctttaaacaacaaggtcgagatagcgcgattcaattcacctttgtgagcaatctgcgcctttttctcgccgtttaatgctgtggcctgattcgtataggtcatccataaaacatccggatcatctgtcgcgaaaacctgcttggccttgccggtatatagtaatgtggtctttttcaccatgctgcctccatttgtttaagtatgtccataacatcgcgctcatcggtcaccgtgatgtggcccattttacggccaggacggatctcggcttttccataatcgtgcatgtgccattctggatgttgcggccattttgccttggcttgggtgagatcatcgccaagcaggtttcgcatcaccgctggctgttttaaggtaatcggcggaatcggtagtccgcagatacttaaaatatgagcgtcaaactgggaaaagttgcaagcttcaatcgaatagtggccagagttatgtgggcgtggtgccaattcatttgcaacgacattgtcaccttcgagaaagagttcgaccccaagaactccgcgtaaatcgagtccaagtgcgattttagtcgccagatcatcaatcttttcagccaaaaccggtgagatatgaggtgccggtgccagtgtgagatgcaagatgtggttcttgtggcgattttcaacaatcgggaatacccgtacttgatcgcggccatcgcgggtgatcatcactgaagcttcccggtcaaactgttggcgtttttccaaaatgcagggaccgtgggctagcaactgctcggctgcgggtacatcagccatggtgttgatgtcttgctgaccatgaccgtcataaccgccagtcgtagtttttaagatgctcggcaagccgattttctcaatggccgctgtcaacgcctcaggccgatcaactgccgcaaagggggtgaccggtacaccatgcgtctgcaggaatgttttttccttaatgcgatcgcgggttgttgcaagaatagctgttccttgagggattcgggttaaatcacgtactgcttccaaagctgctaaatcaacattttcaaactcataggttaaaacatccgattctttagccaactttgtcagtgctgcttgatcgttgtatggtgccgtgatttgaaagtctgctacctgaccggctggtgaattcggcgtcggttccaaaatgccaactcgatagcccattgtcttggcactttgggttaacatacgtccaagctgaccgccaccaataatcccaatcgtggcaggtgaggtaaccacatcaatcattaagtgtggcctcactttcttcagcccgttgtgtttgggcctgacggaaagccgccagccgctgagctaattcaggactttgcaaagcgaggattgatgccgcgtacaaagcagcgttcacagcgccggcatcacctattgccatcgttccaactggcacacctcctggcatttgcacaatcgacaacaagctgtcaacgccatttaatgttcgtgttttgattggaacaccaatgaccggtagcagcgtgttagccgctaacattcccggtaaatgggcagcaccacctgcacccgcaataatcacgccaaaaccttgattagcagcatgtttgccaaatgccgccagctggtccggcatccgatgagctgatatcacgtgcttttcataaggaatatcaagcgcctctaactgtgtggcaacttgtcgcatggtcggccaatctgaacttgatcccatgaccacggctactttttgcatctcgtcccctgctttctttaagatgttttgagaatagcacgttaagcagcaacattcaacactaaaatagaactataaagcatattattcgttttaatgttcgtattttgctcaaacccggtcgagaactccagctttttaaagcaaaaaaatagccttagagacaatctcatctctaaagctaacttattttgagagcacacttatccctcgacagcgccttaacaaactaattgttttaggctgctttagtggaaagtgatttaccatcctttgctataaacagttgtggcgccaccgtgagtaaaataccaacaaccacgattgccaaaacggtgctgaacaaagccgatccaccgttgacgatcagtgaataaatccacacattcatgccttttggcgcgtaactgccccaaaaaacaactccggcgatgaaatgaatgaagtacttagcaaaagttccgacaataatgccagcaaaagcatagccgctagcttttaccttctcaccgccgcggacagccttttgaaatgatgcaaaagtcaagcccatcaagccaaccagcgtaaaggcaattggatattccaaaaagccttgaaccggattcaaaacactgccaccactaaggccgcggaggatcaaatcaagaatcccccatacaaacccggcccacgctgcaggaattgccccacgccgcatcgccaaaaccgcgatcggaatcaacccatagttcaattcaatcgccgaaacaccggttgtatgcggaatataagtcaacgccattgcaaacgccgcaataatcgctgtttccaaaatcacaaccagacgcttatgttgttgcataaaaaaagcctcccagtgaatccccactcacaaagaaggtcgtttccgacattcacaaatccctacgctcgcactaacgaacaggttcgaagggtccgggtctccccgctctcagccaatggctcccctttgtgaaggttcatctaattaattgatacattgtcatcgtaccagactttataaaaagcgcaaacattttgtccagaacagagcgtgagccagcccggttagaaaccggagcataagtggccttgagcgtgatgaccgggttttggtcattgcgctcaaggtccttatgtgcaggtttctgggctggcgatcgcgtttatgagcgtgagccggcgcgttcagaagtcggagtgtaagtggccttagccgtgatggccgggttttggccattgcggctgaggtccttacacgcagacttctgcgccggcgaacgcgtttatgagcgtgaaccgacgcgcttagaaaccggagcataagtggccttgagcgtgatgaccgggttttggtcattgcgctcaaggtccttatgtgcaggtttctgggctggcgatcgcgtttcagagcgtgaaccggcgcgttcagaagtcggagtgtaagtggcctcagacgtgatggccgggctttggccattgcggctgaggtccttacacgcagacttctgcgccggcgaacgcgtttatgagcgtgaaccgacgcgcttagaaatcggagcataagtggccttgagcgtgatgaccgggttttggtcattgcgctcaaggtccttatgtgcaggtttctgggctggcgatcgcgtttcagagcgtgaaccggcgcgttcagaagtcggagtgtaagtggcctcagacgtgatggccgggctttggccattgcggctgaggtccttacacgcagacttctgcgccggcgaacgcgtttatgagcgtgaaccgacgcgcttagaaatcggagcataagtggccttgagcgtgatggccgggttttggtcattgcgctcaaggtccttatgtgcaggtttctgggctggcgatcgcgtttcagagcgtgagccggcgcgttcagaagtcggagcataagcggcctcagacgtgatggccgggctttggccattgcggctgaggtccttacacgcagacttctgcgccggcgaacgcgtttatgagcgtgaacaggagcgcttaaaaaccgaagcataagtggccttgagcgtgatagcctcctcttaactattgcaccgtgatccatacatccagctttctgcgccatgaagcacgttatggtaaacgcattttccacattcacaaagcaactggtctcaccgtcaaaacacaccgcacacctcaccaaaaattttcagctcaacttcaaagctagcgactcagacgaattttttcatcccgatgaagtgtctccaaagattttcctgctgtctccggtacaaacaaaatgacaaacagcaaagaaatgagattggtgccaatgaaacaaacaaaagtccaaaacataccaatgcctgccaaaccgatcgggaaaagaacgccgaccgcaaaattagcgagccacaggaaaaatgtcgccgttcccattcccaaaccgcgtaattgctcgggaaaaatttctgatagaagcaaccacgtcatcgggctaatagcgccttggaagaacgctagaaaaatcatcatcatggtgatggttgtaaatgcgcgccatgaagagcctgcaggtaagcggctcgcgaaggtcacgccagtaattgcaatactagtcccgattaagccgatgatcagcaatggacgccgcggaacatgctttagcaactgtaaggtgacaagggttgctgcaactgccgttaccccattagcaatattggtgattaaggcactattacgaccaaatccggtcatttgcaaaatcgatgtaccgtaatacatcatgacattgatcccggcaatctgctgaatcacgcccaatccgattccgattagcaccagccgccgaatccacttaaccttaagcgccgtgatccggactttcttgtgtttcgcgctggccgcaatggtttgctccaaatgatcaagttctcgcggaacctcttgcggcgcacgaagaaccgacaagctcgcctttgcagctgcctttcgtcctttcataactaaccaccgtggcgactccggaacaaaataaatgccgattcccaagataatagcaggaataaccgctaacacaagcatccagcgccaaatcccaggcatatcaccaaagtttgtccctaacacggcattaaggatgaacgcaagcaactgaccggtgacgaccatcaattcattttgggtcaccagccgcccgcgatggcttgttggcgcaatttcggctaagaaacttggcactaacacggaaacgccgccaaccgctaatcctagaatcaatcttgccccaatcagccaaatagcacttggcgccattgacgaagcaagcgttgccagaaaaaataatccggctaatccagcaattaaccgtttgcgtccataacgatcactaatacgtcccactaaaacagcaccaaatgctgccccaagtgtcaaactgctggtcacccagccttgctgacccggagccaagtgaagttcactggaaataaatggcaaggcaccattgatgacgccggtgtcatagccaaaaagaaggccacccattgttgaaatcagggcaactaaccttaaacgaacacgtgcgctcatcaacgaatggtgtcgttgacgcaagcctgtctttgtttgattctgcaaatacatgcaattccccctcatcaactaggtgaaccgccatacttactagcaaagatccgcatcgcagctcaaccatttagtttacataataaccatagcacttttctgaaaaatctgcagagcgtgagccggcgcgcttagaagtcggagtgtaagtggcctcagacgtgatggccgggccttggccattgcggctgaggtccttacacgcagacttctgcgccggcgaacgcgtttcagagcgtgagccggcgcgcttagaagtcggagtgtaagtggcctcagacgtgatggccgggccttggccattgcggctgaggtccttacacgcagacttctgcgccggcgaacgcgtttcagagcgtgagccggcgcgcttagaagtcggagtgtaagtggcctcagacgtgatggccgggccttggccattgcgactgaggtccttacacgcagacttctgcgccggcgaacgcgtttcaaagcgccacaatccagacttgtgccccatcttccgtcaagagatcacaaccaatttttcaattccaaacaaaaaagcgtcaaccctagaaaggattgacagcttctttaaatcaatacattttattgtccggtagtcttcttaaccagatcagcgttttcgtcgtttgaaatattttcattcaacgcaacgtcagccatcttggccatgtcctcggtggaaagccgcttcatcaagctgcgaaccttaagaacagaagttgcagacatggaatattcatcaagtcccataccaagcaataatggaaccatgattggatcgccagctgcttcaccacacataccagcccatttgccttccttatgcgctgagtcaataacatgcttaaccagacgcaaaatggatgggttatacggttgatacaagtatgaaacatgttcgttcccacgatcagctgccatcgaatattgaatcaaatcgttggtaccgattgagaagaagtctacatacttggcaaactgatcagccaaaacagctgcagcaggaatttcgatcatgatgccaagttggatgttgtcggaaaccttcacgccatccttgaccagcttttctttttcttcggtgaagatctgcttagcctgtttgaactcggcaatcgtcgcaatcatcgggaacataatccgtaagttaccaaaagcagacgcacgcaacaacgcacgcaactgagtccggaaaatatcctgacgatcaagactaatccggatcgcacgataacccaagaatgggttctgttcttgcggtaatggcagatatggcaagtgcttgtccccgccaatatccatggtgcgaacaacaaccggctttggattcatcgtttcaagaaccttcttgtaggcctcaaactgatcgtcttcagtcggtagctcagcagaatccatgtataagaactcagtccgatacaaaccaataccttcagcgccatttgccaagaccccatcaagatcttttggtgtcccgatattggcagcaacatcaaagtgcttaccatcagcggtaactgatttggctgtcttcaattgcgcccattcagctttttgcttggcaaatgcttcagcagcttgcttgaatttggcaacttcatcagtagtcggatcaatgacaacttcaccagtcaaaccatcaacggagatcgtttccccgttggtcgctttcttggtgacatcgtccgtaccgacaacggctggaatttccagcgaccgtgccataatcgcactgtgcgctgtccgtccgccgatgtcagtgacaaaggccttaacatatttcttgttcaattgggcagtatcagaaggcgtcaaatcgtgagccacgataatgacttcttcgtcaattaatgccggattcggcagtgtacgtcctaacaaatgtgccatgatccgtttggtaacatcgcgaacatcggcagcacgttcctgcatatatggattatccgtcatgccttcaaaagtctgaatgaagaattcagaaatttctttcaatgcctgttcagcattgactttttcatctttgatcttggactcgatctgacccgtaaagtcaggatcggccaaaatcatcatatgggcatcaaaaacttgtgcctcttcttcgccaagcgattcagcggcctttgctcgaataacctttaactcatcattactttgatcaagtgcctgctttagccggtcgatctcctttgaaggatcatcaaccgtctttttgtcaaatgataaatcaggttgaaccagtaaataggccttcgctgtggcgatcccatcactagcagcgattcccttcaaatgttcagccattattcagccaagccttcctttttcattgtgtccgtaattgcagcgattgcatcggcttcgtcagcgccttcagcagagattgtaacatcggcaccttgaccaacgcccaaactcataacacccatgatggacttcaagttaacgctcttacctttatattccaagttgatatctgagttgaacttgctagctgcttgtaccaacaaggttgccggacgtgcgtgaatcccggtttctgcaataatgttaaattcgcgtttttccatgactgatctgctccttcgtattaactagatttttctagtgtttttccgaatagtttgtgtgcgtactcgtacccaaaacaattcatgtaaaccttaccattttttccagcctatcacaagcgccacatgagatttgacacttacttagcgggaatcgaccgaccggtaatggtactcgatgacaccatcgcgtttggccatccccacaatctcttcacgatcgggatagtttgtccatgccgaccgaaacgccataaacgtttccggcgtcaccgtgatcttgtcacgctgaccagtctttaactcatccattaaagcgacataatcctgagtcatctatttgcctcacctcacttcataagggtagcataaaagtaggcattgaaaaagcgctaaggcctgatatcactgaaatttttgcatctttttagcactcttgcggttagagtgcttgcattctggtaatgagggtgtatactattgccataggtcaagaaaggtcaaacctttttgaccgttatgtggcacctaattagacaggaaggttgtgacaaaatgttatgtgaaaactgtcataagaatccagccactattcatctttcaaccgttgttaacgggactcggcaagaaatcaatctttgccagaactgttatcaattactcaagaaacaagcaggaggaaatatgaatccaaccaacgcatccgatccatttgggtttggaagcttagatgatattttccgtgcgatgaatcagggaatggatcaaccgcaacagccaaacgcacaggttccgcctacccaggcaggacgcggcggcaacaatggccgcaatggcaacggcggtaagggcttgttaggtcagtttggtgttgatctcactgaacaggcacgcaaaggtcaaattgatccagtcatcggtcgtgataaggaaatctcacgcgtgattgaaattctgaatcgccggaccaagaataatccagtcttaatcggtgaagccggggtcggcaaaaccgcggttgttgagggactggcactaaagattgctaatggcgacgttccagccaagttgcaggatcgccatgtgattcgccttgatgtcgtttcactcgttcaaggcacaggcattcgcggtcaattcgagcagcgcatgcaacaattgattgacgaactgaagcaaaataagaatattatcctatttattgatgaaatccacgaaattgtgggtgccggcaatgctgaaggcggaatggacgccggcaacgtcttgaaacccgctttggctcgtggcgaattacaactagtcggcgcgacgaccagcaacgaataccgtcaaattgaaaaggattctgccctagctcggcgccttcagccggtgatggttgaagagcctagcgttgatgaaaccattaaaattctgaagggtctgcaaccgcgctaccaagacttccaccatgtgaaatacacggaaggcgcaattgaagctgcggcaaccctcagcaatcgttacattcaggatcgcttcctccctgataaagccattgacttgttagacgaagccggttcacgcaagaacctgacaattgccaccgtggatcctgaaaccattaaagctaagattgctgatgccgaaaagcaaaagcaagccgcactcaagcaggaagactatgaaaaagccgccttctatcgtgatcaggtcaccaagttagaagacatggccaaaaagcaatccaatctgccagatgatgaaatcccaaccgttaccgaaaaagacatggaaaaaattgttgaagaaaagacaaacattccagtcggtgaactcaaagctcaggaacaggcgcaactgaagaatctcgccagtgaccttgagcaacacgtcattggtcaaaatgaagcagttgataaagttgctcgggcaattcggcgcaatcgcatcggcttcaataaaaccgggcgaccaattggctccttcctatttgtcggaccaaccggtgtcggcaaaacggaactggcaaaacagctcgctaaagaactattcggttctgaagatgccatgattcggtttgacatgtcggaatacatggagaagttcagcgtctctaagctcatcgggtcaccgccaggctatgtcggctatgaagaagccggccagctaactgaaaaagttcggcgcaatccatacagtttgattttgcttgatgaaattgaaaaagcccacccggatgtcatgaacatgttcctgcagattctggatgacggccgcctaaccgattcacaaggtcgaactgtttccttcaaagatactatcatcatcatgacttctaacgccggatcaactgatgcggaagctaacgtaggctttggtgcaacgttaagcggtaaaacccacagtgtgctggatcagctgggtaattacttcaaaccagaattcctgaatcgctttgatgacattgttgaattcaagccgctttctaaagacgacctattgaagattgtgtcactgatgattaatgacactaacaacaatctcaagagtcagggattaacgattcatgtcaccgatcccgtcaaggaaaagcttgtcactctgggttacaatccatccatgggggcacggccattgcgtcgggttatccaggaacagattgaagaccgtgtggctgacttttacctcgaccatcctaatgccaaggaacttgaagcaaggatcagcaacggagaaatcacagttggcgaaccagccaaggcagaagcctcttcaaaaacagccaagaaataatccgattgttgaagattgaaacgttctcagtgcgaccaattggttatcgtggtcgtaaatgaggctcgcactaaatcggttcaagcataaattgcttgaaccggtttttttattccgaagcttccaggatcaattatcaaaataaaaagttcacgctcttttcttgtcagtgcagcagcgatcagcgcttttgcttgctgaatatacgcctagaaagctaaagttagtggacctcaacgagcgtagttgtatccattccgtccagtcatcacgatgtcaataatattattttttcttaaactgttttataataaaaccagtagggagagaaatggagggcatgaccatgcgattaattaacgtaaccaacagcttcagaaatttggtaaaccagcagctgagcggtaccgatgcccgactcgtcaaagtcttttcactcggtcaaaccacagttgtttatacagaggccccttcgcatattgagctattattcaccaatgaacgccgcaacatccagcgtgaagaaattgccttcacgttagatcgcttgctaaagaaatcaatcggtgatgtaacgccaattatgggccaccacctagcagaggtcacggttcccaagcttgagcgccaggcagaataagccgctgtcattatcagataactttttaggtaaggtcggctgttgatcctcataccggtaagattttcacttactagtactccaagtcctgttggccggtcagtccggaaacacaggcatcaaaaaagcgaccgtaaatggccgctttttttgatgcctgcttttgattatagtttcgccgttaacttgacatccggatacttgtcagcaaaccagcgctctgcatattgattttcaaataagaatagcggatcgccgtgaacgtcctcaacgagcaggttacgggaactgctcatcttttcgtccatttgctcagggtcaatccagcgagcaatgcgggaaccaattggcgtcatgaccacttcagaatgatattcatgcagcatccgaaattggaaaacttcaaattgcaactggccgacagcccccaaaatgtattcattggtgtgataagtcttatacaattggacagcaccttcttgaaccagttgctgcatacctttgtggaacgacttttgtttcatcacattcttcggggttacacgcataaacagttccggcgtaaactgcggcagcttctcaaactgaatcgacgttttcccttgataaatggtgtcgccgatttgaaaattaccggtatcatacaaaccaacaatgtcccctgctaccgctgtagaaaccgtttcgcggctgtcggccataaactcagtcgaattatttagccgcatggtcttacctgtccgatgcaagatgacgtccatcccccggtcgaattcaccagagacaatccgcacgaatgcaatgcgatcgcgatgagccggattcatgttcgcctgaatcttaaaaacaaatgccgagaattccggatcagtcggtttgatttcgccatcttgagcggttttctttggccctggctcaggcgcgtacttaacaaagctatttaaaaaggtttcgacaccgaaattggttaacgcggaaccaaagaagacaggggtttggtcgccagccatgatcttcttgagattaaactgattgccggcatcgttgagcaactcaatatcatccagcgtctgcgtataaatcgaatcttgggtcaaaggctcgctggcatccagttcgcctttgtcgttaagcggcaaaaagcgatcggcaccttcctgtcggtacaattcaatccgattattgacgcgatcatataatccctttaaccctttacccataccgatcggccagttcatcgcatagccttcgattccgagcaagtcttccagctcagcgattaagtccaagggctcgcgaccatcacgatccagcttgttcatgaaggtaaaaattggaataccgcgctgtttgacaaccttaaacagttttttcgtttgtgcttcaatccctttagcagaatcaatcaccatcactgccgcgtcaactgccatcagcgttcgatacgtatcttcagagaaatcctcatgccccggcgtatccaaaatattgatgcgcttaccttgataattaaactgcatgacggaactggtgacggaaatcccacgtttcttttcaatttccatccagtcagatttggcaaaatgaccggatttccgtcctttaacggtaccggcttggcggatgacaccgccaaataacaacaattgttccgtaatggtggttttcccggcatccggatgtgaaataatcgcaaacgttcgccgttttgctacttcttgtgctcgttcttgtggtttcataatctgtttccttccaaaaataacattacgcctgccaacatacctttaactctcaatgctggcatcgctaactatccgcctccttggaaacaacttctaaaggtggcgtctcacttaaatgaatatgcacattgaccagccgagaaccttcgactttaccagtggcaagctgcacccccggagccagttcaagcttctcactatgatgggtcgaaggaatggccccaagttgagtgagcacataaccggcaatcgtgtcaacatccggcgcttctaagttagttttaaacagctcattaaattccgaaatcggcatccgtcccgaaacaatgaagtcgtggtcggtttgtttcgtgtatagcttttcagcctgatcggattcatcatcaatatcgccgacaatttcttccaacaagtcttcaatcgtgacaatgccaacgaccccgccatactcatccaaaagaatggccatctgttgctgcttggtttgcatttcagtcaacaacacgtcaacggggatcgtctccggaacaaacaccggctcaatcatcaccgattcgatcttaacctggtcaaagccaacacgccgggcttctttaagcaggtttttaatatgaacgatcccaataacgtgatctttgtcttcttcataaactggaattcgtgaataaatgttattcaaaattgcatcaatagcgctttgatccggttccttggcatcgatcataaacgcatccgtacgcggcaccatgacttcacgcgccatcgtatcagacaacgagatgataccttcaaacatttggtactcgtccggttcaattgcgccggcattgcgaccattttcaatcatggcaaccatttcttctcgggtaacggactcgccttcatgactaaactccatgggggtcagcttcatcagcaatttagtcgaggcggataatagccagacaaacgggcgcattaacgttgccagccaactaatcggtgtgacgctgatcttggcaacccgttccgtcatctgaagcgccacctgcttaggataaagttccccgaaaacaagcgagaaatatgacaaaatcaacgtcactaaaatcactgccgcttcgtgtgcaaacgaccatgatccaaaaatcggagcgactttatcggctaatgtcgtcgccgctgaagccgaggcaaagaaaccggcaaaggtgatcccgacttgaatggtagccagaaaatgacttgaatccttcatgatggcaactagcttggcggctttgcgatcacctttatcagcctgtgcctgcattcgagcacgtgaacttgagacaaccgcaatttctgcggctgcaaatcctgcattgattaatgttaacagcacaatgaggattaactgtccccatatctggccgtccgggtcactgcccatttcgaatccacaacctttcgtaaaaaaaacggggactcatccccgtagttcgatcactttagtatagcaagaccttatttctttttcaattccgaatcgggcttgtcagcgtgcgtcggggcttcaagtgacaattcatggtcctcatcaaaatcctcgtcattcttatgctcctggtgaaaacgatacagctcatataaataagtaatgaccgtcttaatgacagcgtaagtcggcacggcaagaatggtgcccagcaagccccacagattccccgctaccatcagtaaaatgatgatggtcaacggatgaatatcaagcgagcggccaatgacattaggataaataaaattgccatccgtcatctgaataatcacgacaaccaagaccacgagcaacattttagtccatccttcagtggcagcaataatcaaagccggcgcaatcccgatgtaggggcctaaataaggaatgatggtaacaacaccggcaataaaaccaagcagatacgcatacggcatgccgataatcaagtagccgataaaggtgaacgtaccaacgaacaaacattcaatcgcctgcccgccaatgtaatgcgataaggtcgcgttaagtcgggtaaagacagtagccacttcagcatgataacgccgcggcagcaagcgctgaatacttggaacgaaattttcgccatctttgagaaaataaaagagcatcaccggaatcgtaataatactgataacggtacttgccaacgagccaatcaccccaggcaggccacttgaaaagccgccaagtacctgactcagcagtttactcggggaaatctgcaagcttgcaacatatttaccgatgtttaaccgctgataccaagtataatgcgatgctttgctgataaacgtgcgtacaccttttaagaagtcggggatattcgtcacgaattgggttatctgatagatcaggttcggtaacaccgccatgacaatcaaaacaatcgcaccaatgacaactaagaaaatcagtaaaatcgaaacattgcggctgatatgcaatcgctgtaataacttcacaatcgggttaaacaggtaaaacaagaaccccgccgaaatgatcgggatcagtaacgttgaaaagaaagtcgcgaccggtgcaaataaaaaagaaacctgcgttaagccgatcacgataaaaattaagactaacaattcgactgaccagaacattaattttgaatggcgtaacttatcgaacataatcgacctccccaacgtcttctcactagtgttataatagcaaacaatttatcaaaacggaaagaaggctgacgcattggaagtaaaatcaacaacagacttagactctcaggttcatcacgacagcgtacagataagaacccatgtatttgtggaagaacaacacgttccggcaaatctggaagtggacgcggatgaaggcaaagccacttattttgtcgtctacgatgctggcttaccggtggcaacagcacggattttaccagaaggaaccggttatcacgtccagcgcgttgccgtcgaaaaggcctaccgcaaacacgggcttggaaaaatggttttaaatgcgattattgcctatgcccgcgagcaaaacgttgcgttcctgaagctcggggcacaactgcaggcaatcggcttttataaaacattgggctttcagctaaccgaccagcctgaatttctagacgccggaatccgtcatcgcgaaatgcaattacagcttacgtaaccttgtgtatgatttgattaaaccatccgaatgtgaaaaaaatgcgcttctaatttgattttcttagaagcacaccctgacaagccgcttagttcgtgcttgtttttttattcatattcatcaaccccggttagctgatgcggattgatgtacaggcgataagccacctcggcaaccttaccaccgctcaagcgataactttccagatagtaaggatgatccgtttgcccaagccgctccggaagcgggtatcctgcttgttcaataacgtgtaacccttgattaaagctggtcgctaacggcaattctttcatgagcacgcgatcggcagactgcttcacctgcccggcagttgcggctggtagtttaaaacactcataatttttgggcactttgacgtcaaccggtaacaaactgccaacccaataaataaaggtattgtacggcgaaaaaacaaccaaagctgttcgattaggtgttttagtcaactgatccagtgttttaaaaccaaactggtgttcaaaatccgcccacgctggtgcaaacgtccccagttggtcgctatcttcggttgtatatgcgtgtccggccaacaattgtgctggctgttgtggaatctctttcatgttgccctccaaaacctagtggactaaatccgatgtgcaagctgaatataccgccgataccataaatccacgtatgcctgcgaaaatggtcctttaccgtgattaatccaatcgacaagcactttgacgtttgcctttaagattcgatccgttgttgcaggataatgccacaatttccgatgcgcttcatactcatcaacatctaaaaggcgcttttcaccatcagcgaaaaccttcacatccagatcataatcaatatacttcaacgcttcctgatccattgtaaacggggtggccagattacaatagtaagaaacgccgccttcacgaatcatggcaatgacattgaaccaataatgtttatgaaagaaaataatcgccggttctcgcgttaaccaccggcggccatcggattcggtcaccaatgtatgatcgttacagccgattaaggcatcttcactggttttaagaaccatcgtatcacgccaggtacgatgcaaactgccatcatgtttataactctgaatggcgaacgagtcgccttctttagggattcgcatacttaacccgctttctaaaattccgtgtttcattataacaaacctcatgaaaatacgacagcgcgtaagcaaggcggacggcggtaagtgtcaacttttcctcggttctactctcattaagtgatttccgatactccgggctggcctcctccccaacagcagcctttcgcctcagccgttttacgattcatccaccagctcacttaatacatcatcaatcgcggccaaatcaaagcccttccggaacagtgccgtcttaaccttctgcttgcgggtgcgctcatcatagcgttgctttaagcgccactgtttctccgcctctgtctttagcatggtcaactcggcttccgggtctggctgcggatcgagttttgcgatagctgcctggatagtcgcctcatcaaatcctttttgcatcaggttcacgcgcagccgctgcaattgatctttgtacgcacggtttcgatgatgccgtaagttcttttgcccggcacgaaccgcaactgccgtccactcatctgattcgatgcctgccagctgatcggctaacagctccgtagcaatacctttttgacgaagcttgtattgaacgacccgcggaccggagtcacccattttgagatcggcctccagatagcgcttcacatagtcgacatcatccaaaaaccccagctccgtcaaacgggttaaaatttgtccgatcacatctttgggcagttcttctttctccaaccgttcccggacttcttgacgggttcgactttgatgcgtgatataattcagcccgatctccaagcccatcgcgacgacttcactgtctttaatctgcgcgatcatatctgccgtgagcgtcattcccttggctaggtggtaagtcaccagcgttgtttcactgactggaaacgcatattggccgtccaaaaaaatattgtaccgaccacgccgtttttgtgccgttatcttggtgatttgtgccatgttactttgaccgcctctctaatcatactgtcagttatgttatacttttcataaatatatggaggttagttatgtttgaagccagtttctttgaccgtcatagtcttaccaactaccagctatttcgggcaatgaagaccttgccacaaacaaccttatcgatcaatgcactaagccgcgccactgggttatcgtattctcagacctacacggcattccagaccgttttggttcagttaaatcaaatgatccccgccgagacaatcgacgaggctaattttgcgcaatttttaggcaatgtcacgattaatcaatatcggtttgcgttacttaaagaaagtctgccgtttgtcttctttgatgatgtgtttaaaaacccgcaccctgattttcacacatttaaagaggtacatcaaaccagcgtctccaccttaagaaggcgcatcacgccatttcgtgattatctggctgataatggcgttaacctcaacagtacgacttgggcgatcgaaggcgatgaacttcatattcgtctggcaatgtttactttttttatgctcgcttatcgtggagctggttggcctttttcagccgaagaagaaaagcaagccaaaactttgctaaccgtcatcaatcaaactgatccggactttttactaatgcccgttgaaccaatgtcaaaagaagcgctggttgtgctttccattcaacttatgcggattaaacaaggtcatcccttattacctaatcgccgaatgcaattgctattttccggacatgaggacctgcctgatctgatttttacatcagaacaattcccgaacttatctgattcgcagctgaaggccgaaaagcagttttactattttatgcggctttattttatgacggtcacccgccaaccacagaaaatcgaccgccaattgctgactcattttggagaaaccgacaatctcgtcaatcggtttgtgaccggattggttgaccatttaaatgatcagcttaaaaaaaccgaccgccagcccatcgctgaaagccaagtgatgattgcaaatctgtatcggctcagctttaatgaatatgtccttaatggccgctttagtcagcgtcttgattttgcgcaatcgttgtatgacgaagccgatagcagcaccttggcaactgctattcagcgttatctaaagcaaattcccaagtcaatgccagaatcagtatttgcagatttccccgatcagtttattagcgggctctatttactggttagcgacaactatcctgaactcaaccatgatatgcaaatgattgtcaatgttttgattgaacatgactcatttgccaagcgggacttgttagactttttgaacgatttaggttttattcgggttgttccgccagttgaagcggtcaaacccgacttgatcattaccagtattactaaaccaaaaagggtgatcccgcgtttgggccacccgtttgatcccacgacaccgttgatcacctggatgccggaaccgactgatttggattattttcacctttatcagcgactcaaacaattacaacgccagcatcgatcaaccgctcgctcctaaattgcctcaatgcaacggtttagccgtataccccacaaaataaaccagcgcttcataaccggctagtccaaggatgacagcggtaatcagtagcgtattgttcaaattactggtgcgcgtaaaccataaaaagacaaccatcagaaacatcaccacaaaataggcgttttgcaaactgcggttaacctggatttcaaacttggcatccgggctttgataatcaatcgtgtgtaccgtattcaaacgtcctactttatatgtgattttatcaccacgttgaacttttaaatccagtgtttcaccaacatgcatgatgtgcgcggtttcattttgccacacagtcgccgtcatttttttgctcatactattcgaataattaattttcacagtcaatcctcccgaatcttcattatactagaatcactcgggtatcgtcaccatttgtcagcgtaaaggagtatttcatggcaaccacggttaaaatcggtcaacgttttcctttaacgatcaagcgtctggatattaacggcgccggaatcggatactatcaacgcaagatcaccttcgttatcggtgcacttcccggcgaagtggtcgtcgccgaagtcacagccattcacgatcgttatcttgaagcaaagacacacaaaattcgatcagcctcaccggatcgggtcaccccaacggaaccgctttttgggcaaatcggcggcgttgagttgaaccaccttgcctaccctgcgcagttgcgattcaaacgcgatgttgtcgcccaagcgctggccaaattcaaaccacttggctggcaacattatgatttaaaaccaactagcggaatgacacacccaacgcactatcgcaacaaagcccagttcccggttcgcgaaattgatgggcatgttcgcgccggtttatacgcgcctggatcccaccgcctcatccctctaacgcactttttaactcaggcaccgctgaccatgaaggtggtgacgactttatgtcaactactcgaagaccttcaaatacccatttataacgagaaaaagcacgccggtattgttaaaacgttagtcgttcgcgagtccttttcaactgggcaagttcaagtcacctttattaccaacagtgccaagttaccaaagcaagctcaattgatcaccactattgccgcccaactgcccatggttgtcagcatcgcccaaaacatcaatcctggtaacacctcgctgatttggggaaaagacagtcgtttgctggctggtcagccatatattcaggaaaccttgtccgggcgtactttccaactctcaccgcaagcctttttacaactaaaccctaaacagaccgaacagctttatgccattgccaaagacgccttgcaacttgcgccagatgacacgctgattgatgcttattgtggtattggtacggtggggatgagcctagctaaccgtcaccagtcgatttacggtatggatacgattcctgaagcaattgccgatgctaaagctaatgccaaaaataacggctttaacaacactcattattttgtcggtaaagcagaaaccttattccctaagtggctcaaggaaggtattcgtcccaatgccgtcattgtcgatccaccacgctccggactcgaacggccatttattgatgcgctattgcaacttagcccgcaaaagtttgcttacatctcgtgtaatccgtccacgttggcgcgggatttggtaccgctagccaagcattaccaagtcgattggattcaaagcatcgacatgtttccgcaaacagcgcggtgtgaagctgttgtcaagttcaccagacgttaaactgagtcacttgttacctgattcgggattatgtgcccagttctggtttaacttgacgtttgtacgaatcatcgccattttccaatcatgctaagtgaggtcctctttcaatgaaaatttattttgccaatgcactgtttagccacgccgattttgactacaatgccaaactagcagcccagatccgcaccgccattccaaaagttgatctgtacgtccctcaagaaaatgcggccatcaacaacaaagaagcgtacgcagattccaagatgattgctgaagccgacacgcagcggttagaagcagctgatttaatgattgccattttggatggtcccgtcattgataacggtgtcgcaactgaaattggtgtggcgtatgcacgacatattccgattctggggctctatacagacagtcggcgtctgggcgctactaatgacaagaagctcgccgccttgcaagaagtggcagaaaaccaatttcattatctcaacttatacacgaccggcttgattaagctcaacggtgccattttcaccgatgaagcggccttgattgcagccatcaaagcccgcgcatcggcataatcaaaaaagcttccgtccccttcaatgaccaggggtgcggaagctttttgaattgattcaattaaacatttgcagttgtcttttcagcatcctcgagtaactgccggaaaggaatcaaggtttcggcatgatacttcttaacgaatgcgtcaacggcttctggatcctgcgtttgcttatccaaaaccagttgttcaaccggaattggccgtaaatcggaaatctttacgtcaataacaaccgggcctttacgatccttggccttggcgaatgccgccttgagttcgtccaaattatgaacttcaaacccttgtgcgcccatcgcttcagccgccttgccataatcagcatcaatgagatcaacccctgaatgcggctgacgggtatcgtcttgttccgcttcaataaagcctaaactttcattggtcaggacaatgttgataatcggcatatgatacttcacttgggtcataatatcctgcataaccatcgcaaacccgccgtcacctgaaattgaccacacttgccgatccgggaattcagcttgggcgccaattgcagcaggtacagcatagcccattgttgcgtaccagccggaagtcgtaaagatttgattatcgttggccttcaaataacgcatgccattaatcgttacgttaccgacgtccacctggaaaaccgcatctttgtcggccatctcgttgataagtttgaagatcggttcaacgcgcaatggggtttgcgaatcgtcttcaaatgacgtcatccactcagcccagtttgccttgttagcgactgcagcgcgataccaagcagtttccggtacggcatcagccttttcggtcaatgccttgatgaatttcttggcatcggctaaaaccgccagatcaactgtgtgccgccgcccaaacttgctagcatcaatatcgacttgaatatatttagcatttggtgcgatgaagtatggctggaatgggaagtcagagccaaggaacaaaaccgtatcggcgccgcgggctacttcaactcccggcttcgatgcaacccgaccggcagatcccatgttggccttataatcatctggcacaatgccttttgccagtgcggttgtgatgatcgggatatgcgttttttctgaaaatgcaatgatttcatcgcgagctccacgcgcaccattaccaacgtatagaatcggctttttggcatcctttaaaatgctccaagcggttgccacttgctcgggatccggttcaggcaataacggcttttgataaagattggccgatgaaacataattatcatcaatctcctgccaaccgagatccttaggaatggtcacaacagcaacgccttgatacttatacgcttgacggatggcttcatcgacaacgtgtggcaattgtgcagccgtcatggcagtccgattataaaccgacacatcggcgaacatcgggttttcattcatttcctgaaaatagttggtattcatggctgcagtcggcacctggcctaccaatgctaataccggtacatgatcgtattgcgcatcatataaaccgtttaacagatgaacggcaccaggacctgctgacccaaacgtggccccaatgcgtcccgttacctttgcttcgccagccgcagccaatgcgcccacttcttcatggcgaacctgcacgtaattaatggtgtggcggcgattgtaaagcgcgttcatggtgctatcaaacgatccgcccggcaatccataaatattatgaattccccagtcttctaacaccttgatcattgcgtctgcagcattgattttttctgtcatgacacttgcctccattattacttacattttgtaagttctttacgattatgagtataacaattaatcaataacaatgcaaaccctttcactcgattcgagatcaagtcacggctaaaagtaaggaaagcgctttaatcattgctattatacccacgtcaaggtggtaacagtcaatcaaactgactgatacagagcctgttcgtttcagatagtttgttagcagactgtattttgccttagatgttttcttgcccatttctatccatttcaaaataacggcaggtgctagttgtcacaagatgagcgggcaaattgtcatcactcgctttgacgcgttccccgccgtctcacacttcttcataacgcgctccccggctcgcgcccacacaaaaaagaatgaacgattccatctaagcggaaaagtccattcgttttctattactttttacatggggccgaccgaatataattatcaactaaaacattggtgcttgttgattctgaccagacaagactactttaacttctacacccggttcatcacgattgatgtttttcgtagtgccgctcctggccaatgacaccggtcaaaataaactgaccacgatagtaagccggatcagggcgatagtcatcggcatcatacgggactttatcgctaaagaccgcttcgtattccggtacaggcaattctttgcgtttagttagttgctgggcatgttcggcggcgtgtagttgttccttaaattgtggttgcaaaatgccgctgaagaactctgccacggcaccggaaccatacgaaaacagtccgatccgatccccggcttgtaacgtcgtatcatgatccagcaacgacaacaaccccagataaagcgacccggtgtagatattcccaatttgccgacaataacgtgtgctggcttcaaaacggtttttcaatcgttgggcactcgcgtcatcggtggttggcaacactagatccaatgcttttttacccattttggtatatggcagatggaatgtcattgccgcgaaatcatgtgcgcttaaatgatggtcggcctgataacgttcccagactgtcttgaagaaggcgagatattgttcggttgagtattttccctgagcaagcgccgtatcttggtaaaccggtcgccaaaagtcgttgattgatgccgatcgataaaccgaatccggttcaattgtcagcagacgcggatcagctttgacaatcatcgccactgcgccggccccttgcgtcacttcaccggccgttgctaatccataacgcgcaatatctgccgcaataacgagcacacttttatcaggatgactcgcaacataatcacgagccatcatcagcgcagcggtcccaccgtaacaagcttctttcagttcaaccgcccgcacccattcaggcagcgccaaaagatcatgaatgaataaggctgcggatttactggcatcaaccccgctttcggttccaaccagaatcatgcctaaactggcacgtgatgctggcgtcaatacttttgcggcggcattggctcccagcgtcacaatgtcttgactagatggcggaaccgcctgctcgtcttggccgatgccgatcgtatatttattcggatcatcaccgcgaaccttggcaagttttacgagatcgacgtaaaagtccggggtatccatttcaatggcatcaattccgattttcataatttcaatggcctgctttctgttttgatcgaatcgttgctaaatacattttggcatgtgccagatccatttcacctgcgcgtaaggcggcgactagagtaggtacttcctgatcctgagctccggcagcaatcgccagcgcattggcctgcagtttcatatggcctgactgaatgccggggccggctaatgcgcgcaaagccgctaaattctgcaccaatcctaatgcggcaattacctgctgcatggtggctaagtcgcgataacctccaagacggcgggcggcctgggctagtggtaatgcaccgatcgcgcctccgacaacgcccagcggcaatggcatttgcagatggccttcaagtttgccatcgcgcatcaaccaacgcgataacggttgatactgaccagtcgcagcggcaaacgccccaacactggccgcaaccgcgcgcgtgtcatttcctgtcgccaagaccgccccaatgacaccattaagaatgcctttgttatgcgtcaccgcgcgctccggatcgacaaatgccagatcgctcagctgcacaattttatgggcaatttcatcccctgacagtgtttttgtggcaagtgtggccggtgtcaatttcacagttgccgtgactaactcgccaggtgcattagtcaaaatgctggccaaaaccgttccatccacccaagctgtcactgcgtctgccacagcttcggcaaccgtattcgcataattggcacccattgcctctttaggattaagcgtcaggcgaagttttaaaaaccggttggccaagattgtcacagtcattttgctgaagcctccgccacgctgcaccattgagggatgggaggcattggccacagctgcgatcgttgcttgatgggccaaaaggatctgcctagccgcattcaaatctgctaagtcagttaagaccacttctgccaccacttcatgggtacccacatgcgctaaaacgccgccgttttccgctaccattcgcgcaccattgctggccgcagcaacaacagagggttcctcattaacaatcggtacctgatgttgctggccattgaccattaaatttcgcgcaatgcccatcggtaaggaaaattcaccaattgcattttcaatcagccgagttgcagtagcatcaggaagcgtgcgtaccgcagccaataaagcggcatcggcactggttaacgacccttcttgcacgagttgctgccgcctagcttcgggcgtttgctcataaaacttcattttgatctgctcctaatcatgcaaagtaacttgcatcgccataccgataccaccaccgacacataacgccgcgacaccggtttgttgcctgcgttccgccaaattatacagcaatgaaaccataatccgcgcgccggatgctcccaagggatggcctaaagcaagcgctccgccattgatattcacctgttcgtcagtcagtcctaggtcacgcatcacggcaacactttgcgaggcgaatgcttcatttaattccacttgatcaatggctgttaaagtttgtccggttttttgcattagctggtcaatcgctaatttaggcgcataccccatgatgtccgggtcaatcccgacttctgtatagtcggtgatggtagccaaatagtggaggcctaactgctcggcttttgacttcgccataagaatcaatgcagccgctccatcattaatcccgctagcattaccagccgtgacggtcccgccaacttcaaaaactggcggtaattttgctaactgggctaatgatgtatccggtcgaatcgccgaatccgtgtcaaccgtgacatcgccatgtcggccggaaatggtcaccggcgcaatttgtgatttaaaccggccttctgcagcagcagcggccgcacgcagatgagagcgcagtgcaaactcgtcttgcgtttgacgactgatctgaaagcggctggcaacattttccgccgtaatccccatcggttgctgactaaaagcatcgtttagcccatcgcgactaagaccatccaccaacgcagtatcgccaaacttatgcccggcccgcatcgcctcagcataatacggcacctgactcatactctcggtaccgccgacaagtaccgcgttagcttcacctagttgaatcgccgcctgacctaaccgaattgcctttagcccagagccgcaaacctcattgatcgtcatggccgtggagttcgtcgccatgccactatgcaacgcaatctgacgcgcaacattctggcccgatccagcctgcaaaacattcccgaaaattgcttgatccagttgttgcggatcaagccgtgctgctttaatcgccgccttagctgcggcaacacctaaatccactgcactagcacctgctaactcaccgcccaactttccaatcggcgtccgcttggcactaagaatcacaactttttccataataaccccttttcaaaatgtgagcgtgagccagaccggttagaaaccggagcataagtggccttggtcgtgatgaccgggctttggtcattgcgcccaaggtccttatgtgcaggtttctgggctggcgaacgcgttatggtgagcgcgagccagcgcgcttagagatcggagtgtaagtggcctcagacgtgatggccgggctttggccattgcggctgaggtccttacacgcagatctctgcgccggggagcgcgttatggtaagcgccgagccgcccggtcaagaatccaattcaaacatgcgttataatacatcgaagaagattccatcgctgacctgagcaaccgctacataccaccaatgcccgctcagaaaaaccgttatagtttatcacagtccgaaaaacaaaacatctaaatcgtggcttgcaccgttaatcgcccagattccggttccttgagccgtgattgcatttatgtctagctacataagttcatgttaaactgtttaaattgtatgcgattcttttcggaagtaacacccgtcttcaccaatccttaacttttaaccatagaaagtaggtgccgttgatgcgcgtcattgatttgctcgccttactcgctgaccaaagtaaaaacgcctcagtactgttaaatacaacaccagcaccaagtcgttttgatgattttattttgaaaacccaaaatgatcagccacaattaatctttaagcccaaacctgatcgaaaatcgccattacgcgtgtgggaattacaactgttgttaaatcaccctgacttacaatcacgttttctttatcttgtagatgcagacggcacccgtgcactttttggctttatccaccggccagttggtcttttacttaactaggccggatgttttgccgccgccaactttgctgcaaccttttccagataatggtgactggctatcatttcttggcaatcaaactgatttttcaaaccgatttcataaatccggctggcgttaggattgagctgcggtaaaacgcggtaccaatcaattcggccttgtcccaaaggcaaactgtcatgcgtctgccccattgagtcaaccaaatgataatgccgtactaatggttttaggttggccagactcgctatcagtcgctcattatccccgtgtaacgtgataaaagcatggctagtatcataagccaatggtagccgccagcgcagcaaacgcgcctcaaacgcaggatcgccatacctaaagattggcgacatcgagttttcaaataccacgtgtcccggcgcctcttgagcaaacgcaatcatgcgagccaatgccacatcttgtgcttttgcaacgtcacgccatccggcataatctccgggggtgtccacgcggtagcctccgtgaatcagtgccgtggcgttcacttttttagccagtgtcataagcttaacggaactggtcatcagaaagtcatacctggctggatatttagtcggattcatcgctaactcattgcgctgaccgcgaaaacgcatcgggtggtgaaacacaacagtcggcacctgactttgaacccaggcaaccattttcaaaaaatgttgccagccactcgcggtaaaatctgcttccgtcaagtgaaactcaaaaacgtcaggatgatactgcaatcgatcacgaatctggcgctcatccgtactggcttttaaacccaacaacatgaattgccaacctccttaaaagcaatggacattctagctcggtaatctgcgcatcaagcgtttaagcttcttgcggtcaattaacatcacacccaggtcgtcagctaaggcaatcgccgagtcggaaaactcactgttggtgatgaccgcagcttgatcaagttgataataatgatgccctgcccaaacttcctgaaccgccttattcccaacaaagccagtgtatcgcttacattgaaagccgaatgactggccttttttttgtgcaataatgtcaatgccttgatcacccgaagcctgagtaagttgaatacgcttgaagccattgcgttttaataaataggcacaaaattcctcaaacttctcaccttccatgatgtccacgctctccatcttcaaatctcgaaaccgaaaatgatgatggtacagcaacaacgcattgatcaccacaaataaactaataatagtaaaactggcaggatcgccataaggtcgcaactgccggggcaaaatagtgcggccccaaaaactgtaaataagggccaatacaaacaacccccacaacaaatggtaggcctttttaagtaaaattctcatgcttctaaacccttctagttaagtgagcgtgagccagcccggttagaaaccggagcataagtggccttgggcgtgatgaccgggctttggtcattgcgcccaaggtccttatgtgcaggtttctgggctggcgaacgcgttatgagcgtgaaccggcgcgcttagggatcggagtgtaagtggccttaggcggtgatggccgggctttggccattgcggctgaggtccttacacgcagacttctgcgccggcgaacgcgtttatgagcgtgaaccgacgcgcttagaaaccggagcataagtggccttgagcgtgatgaccgggttttggtcattgcgctcaaggtccttatgtgcaggtttctgggctggcgatcgcgtttcagagcgtgaaccggcgcgttcagaagtcggagtgtaagtggcctcagacgtgatggccgggctttggccattgcggctgaggtccttacacgcagacttctgcgccggcgaacgcgtttatgagcgtgaaccgacgcgcttagaaatcggagcataagtggccttgagcgtgatgaccgggttttggtcattgcgctcaaggtccttatgtgcaggtttctgggctggcgatcgcgtttcagagcgtgaaccggcgcgttcagaagtcggagtgtaagtggcctcagacgtgatggccgggctttggccattgcggctgaggtccttacacgcagacttctgcgccggcgaacgcgtttatgagcgtgaaccgacgcgcttagaaatcggagcataagtggccttgagcgtgatgaccgggttttggtcattgcgctcaaggtccttatgtgcaggtttctgggctggcgatcgcgtttcagagcgtgaaccggcgcgttcagaagtcggagtgtaagtggcctcagacgtgatggccgggctttggccattgcggctgaggtccttacacgcagacttctgcgccggcgaacggtcgggcaacgtgaaccgacgcgcttagaaatcggagcataagtggccttgggcgtgatgaccgggctttggtcattgcgcccaaggtccttatgtgcaggtttctgggctggcgaacgcgttatggtgagcgtgatccgacttctgcgccggggagcgcgttatggtgaccgcaagccgccgcgacacacgcgatcttcacaccatcaaatacatgatccttatcaagcctagcagattcacgccatgtttgcattgaaactcaggtaatttttctgtaggcttaatttattgagaagggaagcgttttcgtcatgaaactaagcgccaaaatttttgccaaagttggcagtgagcgcattacgcaatacacattagtcaacgatcagcaaatgacgctgcgatttttaactttcggcgctcgcgttcagcaagtccggttgcccaatacgactgggttagatcctaacttattgcttgggttcgtcactttagaagattatctgcatcaacccggtctttttggcgccatgaccggtccgcttgcaccagacgaccctaaaacgattccgggagcttggcagaattggaattgggcggtgaaaaccagtcaaacggctgacttagccattaccttttctctaaatttacctgaaaacgctgatggacaaccgggcgagcgctcccttatggttacgcaccgactgaataacgacaatgtctggactatcgatatggccgttaaaaccactgccgaaatccgacttcatccacgattgatattgccatggttattgacagccgatcccgcccaaacaatgttacacgctcagttaaccattgaccaccagcaaagtaccatcaggcaacagccagaaatctcgcctgcacgtagattctccttagccaccggtgactggcaactgcgctatgccaccgatgcgccggccacccgcattgactcgtttgctaacattggacccgataacaactttaacggcattctgggacaacctcatgttgcaatcggattttctcctgaaaacaatttaaccggcaacgcgtggacacttgctgccggcgcaacttggcaacaccacgctgaatatcagttgagcaggattaaggccagtacgccagaccgttaatccaatcagctaaccaaactaatcgctacaaaaagccttggacgttgaatgagctgctcaccgtcacaaggctttttctactggtattagtcgacactaataatttttaaagacatctttgtaaaccttaatactgtcgaacacgtcttggaggtcaacatattcatcggtttcgtgcgaggtgtcattacctggcccgtaaatagccaagtccaaaccatcgtggaaaaataaggccgcatcggttatgccggttcgataggccacagccccgcgctgcaaaccgatccgctgccgtgcctgctggactttttgaattaacgcattatcgggtgcagccgctgcggcacttaaaaccgaatcaatcgaaagtgataggtgaaccccttttggtactgatgttttagcagcctgcttcaaagcggcaataaacgcatcattatcagcaatcatggttgttcggatgttgccgcgtaaataagcagactccggtaatgaattaatttgattcccgccatggataatatcgatgttgtgggtagcgtgacccagaatcggatcatctttagcttgaagcggcgcggtggcagttaatgcggcattggcaaaagcaaataagccgtgaatggcattagccccaagatctggacgtgaagaatgcgccgccttgccctgagccgttaacgtatagtcaataatgccacgttcagccgcatccacattgctgtttcccggttctgcgaccaaaagaccggtcaaccgatcaccataaccggcagccgcaagttggcgggcaccgtagttatcgatttcttcgcccacggttgccatcaactgaacgccatgatcaagctcttcatgcgcgatttgcttaaacgcaaccacagcagcggcaagtccggatttcatatccgtcgccccgcggccatacaatttaccatcttcaatctgggctgagaacggaggaaactgccacttgttgggatcgcctgcatccacgacatccatgtgcccgtcaacccctaaccagcgctgcgcattaggatcaccaatcgtcaaaactaaattgtcgcgtcccggcgcataactgatacgttcacgcttaatcaaccctgtgcttagttccggggccaaaaaggcttcgatcaagtccgccacttggccttcttttgctgccacactggggattctaaccatcgcctgcaatagatcagtaacttgttgttcctcgtctgtcaaactaccgcctccacttttaaaatacatcatcttaacgatccaaatcgccaccatgactgagttcatctagtcacatcagatgccatcaacaccattattccgaacacgcaacccagtcttttaacgcagccctattttcttctaaagcgcaacaatgcctgacctaagattggggtgacaatcccgccaagcaccgcctctgccaccgcattaatggccaaggcagtaatcaacagccaacctaaattcgttgcattggctcctggaacgatttgcgcggctttgctggcaaacaacaaccaggtaaagccgatcaccagcaatgtattggttaaagcgcctgtaaccccggcgatgaccattttaatagtttgagccagcgtactctggtgtcgtttaaataattgatgaaaaacaaaagctgcaaccaaaccaaccatgactcgcggcaccaacgcgataattggattgcgaaaaagcagtaaagttaccgggtcagccgctgatgtataagcgcgaatcagactcgttaagccccataataagccaaggctggcacctccgccatagcccaatacgatcccgccaatgatgacggtcaagtgaatagtcgaaatagccggccaagcgggaaaaatctgaacataaccaaccattggaatgtaggcttgcaaaataatcaaagctcccaaaataccaatgatcgcaatgttataagcttttccgcgacgtgtcatgctgacacctcctaatcgtttatagctaattttatcaaattatacacgcttacgtttgtttatattgtgttttctgctgttgctggttcaatcaaagtagaccattgcgttcaggtatggctcatgctgggtcaatagtccatgctttgacaatattgcttgcggtcgccagtgttagctaccgctgaggccgcttgggttctagcttatgcccttgacgcgctcaccggcgcagaaacctgcgtgtaaggaccttaagcgtaatggcccaagcccggccattacgcttaaggccacttacactccggtttctaagcgcgccggttcgcgcttagtacatggcgtaaagtttaagtgggtgatatctgagctgacagaaagggagcgaatcccttcgtgctacaatgttaattgcaagaaaaacacgatagcagtaggaggaattcgctcttgtcacctatagtacaacaaatcattttagaaatgttgaaagaaattgatgaatctgtcatggagatggtcgcgggcaagctggatttaagtcaattcattttaaccaatcaggaaaactttcgtgagcacctctgccagttagttgggcaggcactggaacaagtggaccaagctattatggacagtgcttaccgccgtcgattctatagcgtcaaagataagcgggaacgcacttacttggcatccattggctcactggttttcacccgacgttattatcaagataaacggactggcgagcgtgtcttcttgcttgatgaactcgttggtattgagaagcgtagccgactttcgctcgacctcaaagctaagctgctggaagatgccgcccaaatgtcttacaagcaatcaggagatcgtaacggcgggggtacaaaaccatcgaagagcaccgtcatgcatgttgttcatagagacgggaaggccatcagcgctttggatcagttaaaggatcaaccaatgcccgtaccggaaacattatttgtcgaagccgatgaagatcatgtcccccatcaggacggcaccaatcatttcttgaaaatggtttatgtacatgaaggttatcggtctgtgggtaagaagtttcagttgattaggccattttatattaccggtgaatacccgggaacagctggtactgaagaaatctggcaaaccacgcttgattgcatcatgaaacaatatggcggtcagatgcccaaacgcttttttctggccggtgatggtgccagttggatcaaaaccggggccgattttctacccaactgcacggtggtctacgataaatttcacctacgtaaagcgtgcaaacaagcggcaattggcgtacccggtaatctgggcgatattctcatgcattgggcgttacaagggcactcaagctatctaaatgattatttccgtgttcggctcaatgaccctcagttacggtcgtcagaacgcaaagctgtccgacaagcacgaacgctcattcacaagaattggaaacaaattcaggccaacaatgatccagactttcacgggacatcagctgaaggtcatattagtcatatgctttcagagcgcttcagttcgcggccaatgggctggtcacaaactggcacagacaatttatcacagacgcgggtatacgtgcttaagggcggaaacgtttttgagcggttagaagccgaagccaaggaacgtcaccaaacaaagattgatattcgcgttgatgatcgtattaagattcagtttaaatcagcagccacgaaatactcacaagcggcgcaagcagcgtttgtagaactcgctagtgggaaacatcgcggctggcaatacggtatcacacatcagttgtaagttgaaaaagcattctagcaaaaagtttacaagttaaacccacaaaaagttgacgccgtccgcttagtaaatttctattgactttaatctcacgttttcctataatatttcttgtgcttaattagtcatgcgggcatggcggaattggtagacgcgcaagattaaggatcttgtgagcatttttgctcatggaagttcgagtcttcttgcccgcatcatagcaagatccgatcaacaaggtattactgttgatcggatcttttttattttatacctgatcatggaccggcttgaaaaatattaagcctctgaaaggagtcccattcgatgcttcgtgaagcccaatttgtcgatctgccggcgattgttcatctttatcagcagcttactcaagagatggctgcattggcgccggatacttaccggcccttaaccaccgacaatcggcagtattttgctgattacctgcagaatgatctggctcgcctattcgtcacggaaagtcaaggcacacttaccggctttgcattggtcgttttagctcgaaccggggacagccccgaattcgttccacaacactttgcgcagttgattgacttgtttgtcacgccggatcatcgtcatcacggcctagccaaaaccctcatgacagcggtcgaggcattcgctgccagtcatcaagcctcttttattcaactgaacgtcctcagcggtaatcaaaccgcacgagaagtctatgcccgcgccgggtttcagccagtcaatttaatcctgcaaaagccgcttaattagttatttcgcgttgcctgcagccgtaatttgccacggcagacaccgcacgcgtaccgagtgacattcatccgtcggcgccgaacgaattgccgaccacaccttgtgcattgataaacatagtgtcggccgctcatcggcagtggcggcgcaaaccgcgagccgccaactgctgccagtaactgtttgaagtcatgatcgcgatgttgatagccgcgatgctgggcgaacaaatggtagtgcaccaattcatgcttgatgatgccatccgtgacatcagatggataaagcgcaaaaattttggggttaaaatccagattcatcgtcgcaggataaaaccggccgccagtagttcgcaagcgcgcattaaacacggcttgatggttgaacggttggtgaaatgcgctcatagaaatggcttccacacgtgcttgtaattcttggtttgtcattgtctcatcgttacctccgagccaatagtgtacatcagcacgtcaccaattgcactatttgtatcaggctaccttgcgagactatccgatacctgttgagtatgttcatctcactattcatcagactacaaaaaggaacggttcagacgtccacctgaaccgttccttttttctaaccatgaaacttgcgcattgaccaagcaaatgagccatcacaatcagatttgcctacctttttcacactcgcttaattgaaaaaggctaagacatcggcacgcttcaatgctgcttttcgtttttgatcgaagtctgccacaatctggccggcatctagcacaatgagccggttgccatagcgtaacgcgtcttcaacttgatgggtgatcatcaaacaggttaactgttgctccgaaacgatcgcattcgttaacgtcataattgcctgactggtgtggggatctaaggctgctgtgtgttcatcaagcaacagtaaatccggtttgcgcatggtggccattaacaagctcaaggcctgccgttgtccacctgaaagctgctcggttggcttataaagcgcctcagccagaccattaccggtttttgcggccaaagcctttagctgggctttttgtgcattcagacctcgggaacgtaaccctaggcgctgaccacgatggctggctagtaataaattctcagcaaccgtcattcgcggggcggttcccattttcggatcctggaaaactctggcaatatgccgagcacgctgctcaggacggcgcccgttgagtgtttggccagccaaagtgaccgtgccgccgctaactggtagatcaccggtaatcgcattgaataaggtcgatttaccggcaccattatgacccaaaacggtgacgaattcacctgttttaaccgtcagcgtcacatcttgcaacaaggtcttgacttgagttgcaactggcacattaaccgtcacgtgatccaattttaattcagccatggatctgcacccctttctgcaacacacgtcgtaatcgtaattgatgatcaatttgcggcaccatgatggcaatggctaacacgaccgccgagatcagtttcaaatcatcggcattgaaccctagcgccaagacgaccagcaagacaaagcggtaaataatgctccctaggatgactgccaccaaccgctgcgacaaagtcaactcaccgaaaacaacttcaccgatgataatagcagctaacccgataacaatgatcccgatgcccatgttcacgtccgcatagccattattttgagcgagcaatccacctgcaagcccaaccagcccgttgccaaccattaagcctagaaccatctgatgatcaggattaattcccagactccgcgccatattcggattatcacccgccgcaatgaacccttgacctaattgggtgttcagaaataacatcaacaatcctacgacgaggacgacaacaattaaaccaataaccacgctattaaagtagggcggcaagtcttttaagaacgatccttggaaaagattagcctgatgtagcaaagataaattggcccgccccataatccgtaaattaatcgaaaataaaccggtcatgaccaggatcccggcaagtagcaccggaattcggcctttggtagttaacaaccccgtcaccagcccggcaagcatccctgctaccgttgcgagcaaggttgcgataatcggggaaataccgtgagtaatcgcactgacggccactgctgcgccaaagggaaatgttccttcaaccgtcatatctggaaagtccaacacccgaaatgttaaaaagagacctagtccgattaaaccgtataacaatccttgcccaattgcagaaacccctaaactcatttgatcaccgttcctttcgcctctgcctgtttcactaacgaactcggcaatgttatccccaactgctgcgcttgcttttcatttaaaatgagtcggccggttttttcaaagtggatcggcgtcgtggccggtttggctttgccttttaaaacatccgccagcatatgcccagtttcaacacctaaatcaaactgattaagtccgatcgttgccaccccgccttgtttaaccatggtatccacagttggaaaaatcggaacctttcgtgcgttagccgctgccactaaagtttgcatggcgctcgccaccgtattatcggtcggcacaaaaaccgcatccacctggcttaccattttcgttgccacttggttaagatcgttagttgagctaatcgcataccgtttgaccgtgaatccttctttggggcctagtttagccaccatcttggcttgggtttgtgcggaatcatcactggaagttgcaatgacgccaagtgttttcgcatcaggcatgatctgacggataagtttcaattgagctgcaatgggtgcctgatcggaaaccccggtaatattgccgcctggttttttaacatttttaaccaattttgctgcgactggatccgtaattgcccccaagatgatcggcgtcttttgattcacattggctagtgcttgagctgcaggcgtagcaataccgactgttgcagcggcatgttcctcagtaaagcgttctgacattgacttcagattactctgatcgttttcggcattttgaaaatcaatcttgatattcttgcccgccacgtagcctttatctttcaatccggcgataatgcccttatgaatcgcatcaagcgccgggtgggtcgtcagctgcaaaatgccgacagtcggctttgtctgcgtctgttgcgcagttgtgccactttgaaaataagcaatacccaaaaagccaaagatgatgatcataaatccaagcattcgtttcattcgcttgcctccattttaaatattccaatagctttggtggtgtcgatcctttaatgtgataccgacatattccgcgtggttaaagctactttgcggttaaccttcccttttttgtatcaataaaaataccgcgacaggttcaggccgtcgcggcaataaaaaaaccgcatagccccgtgattgggtatctatgcggacaataaatcggaagccaacatagacacaacctgcgcgtctggcaggctgcatccgcaacctacctaaagttggctttgccagttctttaaggtacgcaatgctgtcatgtgggtttcctccattcgtttatacttgatgagatgttagattaaaggtacatgagtaaacatttcatgtcaagaaaaatcattgcaagatgagcgagattttttgaatctgcttggtaaatttctgaatcgtctcatcctgcgccttttctgaagcattaaaggcgggaacatctacttctaagtcaggttttaagctggcagtcattgcttcacacgttgcggtaaaagccgcaaagtcatgaaccaacgtacgatgcggcccagccagtcgcgccggaactgccacttgttgcaaccgagttaataacttttggtactgagcggttccttcacgaaaaacgacctgagtatcctcataggtctcccgatcatattcagctaactgatccgcatcaattgcttttcgcaacggttcgaacaatggtgccattttatcttgattagcctgaatctgttccaccacatcattaatggtcgaaccataatgcgccaacttcatttgttgcttattcatgaaaagcacgaatcctctcttaagcacgtggttgtcattgctgacctgccaccttttttatttagccaaacgtcggcgccgggcgcgttcaaacaccttcacgatttcgacgatcacaatcatcgacacgcccgcgccaagaaccgttatccactgatgccaatcaagggtggtgacatggaaaagcccgttaaagcccggaaccagaatcgtcactgccagcaacaggaaggatgccaaaatagcccagttgaatgctttattccggaatgcacccactgtaaacaggctttgatggatactcttaacgttaaaagcatggaagagttggatcaagcctaaagttgcataagccatggtcaaagcatccgcatgcatcgccgcttcaccgctatggaccggataagtgatagcaatccagtaaacgcccaatgtcaacaagccttcaagaatcccttgccaaatcacggccggacccacgccgccagagaagaagttggattttcgcccgcgcggtttttgcttcataatccctggctcagtcggttccaccccaagtgcaatcgccgggaaggtatccgtcaccagattaatccaaagaatgtgaaccggcgctaaaatatcccagcctaacattgtcatcatgaacaaggtcaaaacttcaccaaggttagccgacaagagatattgaatcgccttttgaatgttggaaaagacttttcggccttcttcaactgcgaccacaatcgttgcaaaattgtcatcggccaacaccatgtccgaagcaccttttgaaacttctgtcccggtgatacccatgccaataccgatatcagctgcttttaacgcaggagcatcgttaaccccatcgccggtcatggcaaccactttgccttttttctgccaagcattcacaattcgaaccttatgctctggtgcaacccgtgcgtacacgctgtatttgccgacattcttagcaaattcttcatcgctttgttgatcaagttcggcaccggtaataacggcagcatcatcaccttgatcaataatgccaagacgaaccgcaatcgcttcggccgtgtcgcggtgatcaccggtaatcatcattggccgaataccagccgatttagcttccgcaaccgccgcttgtgcttctggccgctccggatcaatcatcccgacgagccccgcaaagatcagctgttgctcaacggtctctgagtcaacggtttcaggaaccgcatcaatcaccttataagccatccccaatactcgcaaagcctgggtcgccatgtccttatttgctttcaaaatggcatcgcgttcactgtcagacagaggcgcaacgttatcgccggtggctaaattcgtcacccgcttaagcaattcgtccggtgcgcctttcgtggcaaccagaatcttgccgtccgggcggcgatgaagcgtcgtcatcaatttacgttcggaatcaaacggtacttcagcaatccgcggttctgcagcaagttccttagtaagatcaaaggactgggttttaccataagcaactagcgctgtttcagtcggatcgcctaataattgaccatcatcttgaacctgcgtatcgttggcaaaattcatgatggtcatcaaaggattgccaccgtggatacctgcgctggcagcgttcaactggccatcataataaactttttcaaccgtcattttgttttgggtcagtgttccggttttatcactggcaatgatgtcggtactacccaaagtctcaactgctggcagtttacgcactaatgcatgccgctttgccattttttgagtgcccaatgccaaaatgatcgtgacaatagccggcaacccttccggaatagcggcaacagccagcgaaaccgcggtcaggaacatctccggtaaactggcggcattacgccaaatcccgactgcaaacacaatgacagcaataacaagaatcatcaccgtcagcgtcttcccaagactcttaagattttcttgcagcggggtggttgtttcctcggcagaattaatcataccggcaatccggccgacttcggtttgcatcccggttgcgaccacaacgccaaccccgcggccataggtgatgttactgttcatgaaggccatgttggtccggtcaccaataccaacatccgcacccgtcaatggttcggtggtcttatcgaccggcacactttcaccggtcagtgcgctttcttcgatctttaaattagcactttccactaaccgtaaatcagcaggtaccacatccccagcttccagcaacacaatgtcacctaaaaccagctggctgctagggatcgtgagtacttgatcaccccggcgaacatgcgcgttaggagtggacatttctttaagcgcatcaatggcctcttcagctttgctttcttggaaaacaccaaaaaccgcgttcaataagacgaccgcgagaataatacccgcatcggcccattcacttaataagaacccggcaatcaaagcagcagctaacaggacaataatcatgaagtccttaaactgatccaaaaagcgcgccaacatgctcttcttttcagcctgggcgagttcatttggcccattttcatttaaccgagtctgagcggtttccttagatagtccagtcaattgcgttttttcttcttgcaaaacttcttgactgcttaatgcatatggcggtttctttgccaaaatagtgcctccttctttctttgggccggtagccaaaaagagacttatggcctaccagcagtagatccataagtctcactatttaagacaacaccagacatagccttgttggtgacgttgtcgcagatatgctctgctagttactcccctatgttgagtaaagtatatcaggtctaggcaggcttacgcaagttcctgagtagtgagcgcgaaccggcgcggttagaagtcggagtgtaagtggccttaaacgtgatggcccgggtttggtcattgcgtttaaggtccttacactccgacttctgcgccggtgagcgcgttatgggcataaaacaggacaaagcggccttaaacgtgatggcccgggtttggccattgcgtttaaggtccttacacgcagacttctgcgccggtgagcgcgttatgggcgtaggctagaaaaaagcgacctcaggcatgattgccggactttatcactgtggctaagatcctttcaattttaatcaagctcactcaccccaacgtttgaaataaatgcactgccagatcatgcaaatttagcgcatgtgaattgtaattacttaacaggatgatcgcattttgaccatcgtgactgattgcagtcgatgccatttgaccagcgacaacgccatgagttgaataaaaatcttgatgattatagatgccggctgtataaacgccatcgtcacggttgcgcaacgtcttcaaagtggacaaagtgatcactttgccgctgtctatcccgcgcaatagccgataaagatcacccgtcgtcgtatacatgttgccggtaccgagctcgcggttataccataactccggttcgccgataaaagtctgataaggattggtgacgggacctgtatacgtcaaagaacggtttgaatctgtcagcatcgccggtaaaaagccggtgtgcttgagctttaggcgttcaataatatcgttttttacttgttgttcataggatcgcccagcgactttctcgatcacaccggctagtaaaagatagttcaccggttgataggcatagttttgttgtggcaaataggtcatgttggcaatggcccaacggataatatccatatcacccatcacggcaggttgatacttcttaagggcaaaaccgctgcgcatgtcaatcatcatccgcaatgttacttgatcgccagtttggatgcctgacaaatacttgctaaccggatcgtctaatcgtaacttgccagcttcaaccagctgcatcacggcaactgcggtaatcgctttttgaatcgagccaatttgaaacaaagtcgtcggtccattaagccgctgcgatgcttgatcggcgtaacccacaccaccgttgaagatgaccttaccatgttgaatcaccaaggcactgccgataaatttgtcattggtcaaggcctctgaaaaagattggccggctttggtttcaaccgaacgatccaatttttcgtcaaataacgctgcttgtgtcttggccgtatctttgcgcgttactttttcacgatactttgatggcttgacccgtgcctgacgttgtgaagctgaatgatcttgctgccagccaagaacagtcccacctaatagcaatgctgccaaccccaaaacaacgcctacccaaatcatttttcgacgatgcaacacgttttcatcctcccatttattgctcatcaaagataccttaaaagcagacaaaaaaacagccacgaccctcaataaaagcaaaaatttcattgaagttagctgttttttgggttatttccaaaatgtatcgaaaacagtgattggcaaatgtcgtttgtgagcagtcttctggtaccaacgctcgatggtttcagcagcttggtcgctaacttgtttgccttcaagatagtcatcaatatcgtgatacttaaccccaagcgccacttcatctggcaaggccgggcgattgtcttcaaggtcggctgttggcgccttttgatacaaatgagcaggtgctcctaacgccttcaacaatgccgcgccttgccgtttgtctaaccggtaaagtggggtcaggtccgcaccgccatcgccaaacttggtataaaaaccagtgacggcctcagctgcatgatctgttccgatcacggcccctgccatgttgccggcaatcgcatactgagcaatcatgcgcatccgggctttaatattgcccttgttgaaatcagaaatagccgcaccattggcttcaacagcacttaccatcgcatcaacacttggtttgatattaacccgtttaaccacatcggcttgcataaactcgatggccgccatcgcatccgcttcatcagcttgttcaccataaggcaggcgcactgctacaaactgataagtatcgtcaccggtttctgcccgcatctcctgcatcgccttttcggttaacgttccggcaagcgtcgaatcctgcccaccggaaatgccaaggacataagtttttaaaaaggtattcttcttgagataggcttttaaaaaatcgatactccggcgaatctctttttccggatcaatcgttggcttgacacctaatgctttaataatttctgcttgtaatggacgcattatttcactcctttaatcatatcaagaaatagactttgcgcgagatcccgcgttatctgaccggcattagccatgagaaccactgcattctgcccgctactatccatcaccgttgccgccgagtgtgctgccacaacgccatgcgtcaatgtgtagctgccaaaattataaaccccggctgtatattgaccttgacttaaatcgcgtaattgcatgacggcggatcgactaataattttaccttggttaattccggccataatctgatataagtcaccggcactagcataaatattaccggtgcccaactcgcggttataactcaacgctggctcgatataacgcttcgaatacggatcagccttgggaccattatagccaaaagcctgattttgttcacgatataattcaggcatgaatcctgaatgagtcaaggctagccgcttgaaaatttcctgttgaatcaaatcagcatataagcggccggtaactttttcaatgacacccgctaataacacaaaattaaccggttgataatcataccgaggtgtttcgtaattcaagttggcaattgaccagcgaacaatgccggcatcggaaagttttgccggttgcgcacgaggtagcgttagcccgctgcgcatatccagcatcattcgcaatgtcaccttcttgccagtacgaatcccggtaaaatagtgaccgatcggatcggatagtcgcaccttgccttgttcaaccagtttcatcaaaagcactgccgtcagccctttttgaattgagccaatttgatacagtgtttcgggaccgtttaaacgccccgaggttgcatccgcataacccagaccggtattaagtatgaccttacccttgcgcatcatcaaaaccgtcccgctaaaatgcgccgcctgcaattttgccaatagcggcttggcatccggcgcgtcaaccggctgcatcaatttattagtggtaccggtatcggcttttgcctggttttgcagccgctgctcaattgcgcgatggcgattcagttcggtttcatattgacgccgcgcacgctcttccttggcggctatctgcggacgaacatacaaataatcataactgccataaatcgcaatgccggcgatgaccccaataacaaggcctaacaacagccaccggccccaacgccgcttttttgtctgtctcacgctatttcctcgattattcttcgcgatcggccactgcagacttcacttttttaatcaaatccatcttgttatcccaaacccgctgcgatagatcaaccggataatcttgtggattcaaaattcgccgatactcatcccacagcgcgttggtactgcgtgttgcataagcttgaacttcggctagcggcggggtttgataaacctgcttcccctgatcataaataagttgaagtaacggcttggcctcgaaattcttaaccgtcttattgatatatggaaaattcggatgaaacatatacaaactacgctctggatcaatcacttcgtctgccagtgctacataatcaccttcagacttgccatcatcacgccgcgtaattcgccagacttgttttttgccaggcgtcgaaactttttctgcattattagacagtttgatcgtatcgtgcatctgcccagtgctgtcttcaatcgataccagcttaaacacagcacccaacgctggttgatcataagccgtaatgaggcgagttccgactccccaaatgtcgattttggcgccttgcatcttcagattttggatggtgttttcatcaaggtcgtttgaagcgtatattttggcagaagtataaccggcatcatctaactgctgccgaacacgcttggaaataaacgccatatccccactgtcgatgcgcacgccgagaaaattgattcgatctttaaactcattagcgactttgatcgcagcaggcacgcctgatcgtaacgtatcataagtgtcaactaaaaagaccacgtcgcgattactttcggcataagccttaaaagcctcatagtcgttgccatatgcctgaactaaagaatgggcatgagtgccaatgatcggaatgccaaattccttacccgccaagacattgctcgtggcattaaacccaccaatatacgccgcccgtgtaccccacaaagctgccgctgtctcctgtgcccgccgcgtcccgaattccatgagcggatcagcgccagccacactacgaatccgcgctgctttcgttgccacaagcgtttgataattaatcatattcaaaaccgcggtctcgaccaactgcgcctgtgccagcggaccttcaatctgccaaatcggctcattattaaaaaccaaatcgccttccagcgccgaacgaacggtacaggtaaattcaaaatgacgtaaataatcaataaacgcatccgaataattggtctgagactgaagataagccaagtcggattcggagaacttgagatgattcaagtaatcaatcacatgctctaacccggcaaaaaccgcaaatcccgaaccaaaaggcaactcacgaaagaaaacttcaaaaacagcatgacgttcactgattccacgttcaaaaaaagtgttcatcatattcaattcataaaaatcggtgtggagtgtcaatccttcacccaattgtgtggtcatcatctttccccttccagagacatcctaataggagctatcgttaagcattgagcatttaatttaataatatagctattgattatatactaagtaggcattaattgcagagcgtgaacccggccctgagcgcgaaccggcgcggttagaaaccggagtgtaagtggccttaagcgtgatggccgggctttggccattgcgcttaaggcccttacacgcaggtttctgcgccggtgagcgcgttatgggcgtaagctagaacacaagtggcttcaggcgtgagggcccgcttttggccattgcgtctgaggtcattacacgcagatctctgcgccggcgaacgcgctttggagtaggccaacccaccaacctataggatccttacacacgagctcagagttttgcaaagtcatttcagcaaataacttttccttccaccccaaccccaaaaagccagaaaacaaaatcacttctgctttctgaccttagaccaattcattactttaacgctctaaataaaattcaaaccgttcgccaacatactgagtacgtacatattcaaacggtgttccatccttgagaaatgaaacttgacgcagccgtaaaatggcatcgccgcgtttgatggctaagtattcagaaattcgttcgctagccaacatcgcactgaccgtttgttgtgcgccgccaagaacataaccgccttttttctccagtgtgtggtaaaagctggctgtcatttcttttttggtaaaacctttcacaagatcgtaaggcaccgctgcggtttcgaaactgatcggtaccttatcggcataacgaattcgttccatccgcagtacctgttcagcaggcgcaagttttagcttctccacttcggaacttgtcggttgggcgacatgatacgagaccgttttactggaaggcaccttgccttgagcctgcatcagatccgtaaagctagtcacaccggacattttttcctggaccttttgattggccacatacgtccctgaaccaacccgccgttccagaatgccttcatccaccagcgtttgaatggcttgccgcagtgtcatccgcgacaccttaaacgtgacggctaaatcgcgttcagacggaattcgatcgcctacccgccatttaccggcttcgatatcagcacgaatggcgttatgaatttgaatataaactggcacatccatcctcatcacctcctctttttatggtttaagcttccgtatcgtgtttctcaccataactgtaggtcgcgatcaaatcatgattgcgatccaacatattaatatctgcatctttaccaacttcaagtgttccctttgaagtgagattaaattcacgggcttgattgacagaggacatttcaactgcatcgaataaggaagcgtccatgaagctcatagcatttttaaacgcatccttatacatcaaaacggaaccggcaagtgtcccatcggctaagcgagcctgcttatccttaacataaacagtttggccgcctaattcactcttaccttctggcatacccttactacgcatggagtccgttaccagttcgatgcgttccggtcctttttgatcaaaagcgagccgtaacatgtccggaacaatgtggaagccgtcgcaaatgagttcacaatacatgttatcttccaacatcgcatggccggtaacgccgggttcacgatgccgcaaaccacgctgggcattgtacaaatgagtgacgtgggtcgccttacttgccagcatttgttcccgcgtcgcattgctgtgccctactgatggcacaatgttatgcgccaaaaggtagtcttcgaattcacgcgagccttcatcttcaggtgcatacgtaatcagcttaaccaatccgccagacagttcctgccattgtttgacaagatcaatattaggattcttaatatattcttctggttgtgcccctttgaagaccttactgatgaacggaccttccaaatgaacgccttgaataatgcgattgcgttccgctgcctgtttgaccccacgcatcgccttatcaatgttttcagtcgattgcgtcatggtggtggcaaaaagggtggtgaccccttcatgagtcatcattttagttgccatttgatcgatctgatcagcatcgccatccatggcatcaaacccatagccgccgtgtgcgtgaacatcaatgaatcctggtatcaaagttttgccttgaacgtcaacgacctgttcgccagcctgtgcttgataatcaaacatatcgccgactgccaaaatcttgtcatcaaagcggatgtacccgtcttcaatccgttctaatcctgtataaatcgttgcatgtttcaataccgtaaccgtcacaataccactcctaattatttaaagtcccgaatatcaccaattagtataaccggtatagaccagacttgcaagttggctaaccggtcgtccaccttgatcaaccgtgacgatctttggcaatcgttgcatcaacgcctttgacaaccgcagtcatgagtccagcctcttccatcgccaacaacccggcaactgtggtaccacccggactagacacttgatcgatcaaatcaaagggcgattgatcgctggcgagaacatttttggcactgcccatcaccgcctgagcaacgatagccgttgcctgatccttctccagaccatatttgacccccgcgcgcgccaggctatcaataaacaaatagataaacgccggagatgaaccagctaaagcgacaaacgttgaaaactgttcctcaggcaaggacatggtctttcctaagacattcaacaaatccaaaaggccatctaattgaccagccaccgcatcgttagccgcataagcaatcatcccggcattaatcgcaacattaacattcggcataatccgcaaaaccggttgatcgtgactgcctaatgcctcctcgagtgtcgccacggaaacaccggttagcatcgagacaaccggaacatgccgtttttttaacgttgatccaatcgcttgtaaaatcggttcgcctaattttggcgatactgccagaaaaacgatatctgcagtctccgcaactgcctgattactggccaatgcttttgcaccgattttggcggcatatggttcataatgaagcggctggccgccatgtaagacaatatctgttggtgcaactgcctttttagccaataaaccacttatcattgcccgcgccatattaccggcaccgataaatccaattgtcattcttattctcctttagccatctgcggttgtgcttgatgggcgtcaaaccaatccacaattgcctgcaatcgtgccactcgcaaattcggcaacccgctgcgggacaaatcatgatttgactttgggaaacgcatgaacttggtttcaacaccatgcagtttcaggccaatgtagaactcttcgccttggccgatggggcagcgttcatcattttcactgtgcatcacaagcgtcggtgttctggcatgatcaatgtgagctaatggtgaaaaatcccaaagcccttgcacatctgacaaatcgccagtccactttccttctagttcccacggtgtaaagtaataaccgatgtcactggtaccatacatactcagccaattggaaatcgaacgctgggttaccgctgctttaaaacgatgcgtatgggtcacaatccagttagtcataaacccgccataagaaccgccagtgacaaatagacgttgcggatcaattgttgtatcgagctttagcgcttcatcaaccgcagccaagcaatcttcataatcgccttgcccgtaatgtttaatgacagcggccgtaaatgcctcgccgtaacctaaccctccacgcggattcggacaaatcacgccatagccttttgctgccaaatattgcatttcatggaaaaaggtatagccatatccgactgccgggccgccatggacatacaaaattgccggatgcgaggatgacgcctgttgcggtggaaaataccagccctcaatctcaaaaccgtctcgttgaaaattaaacgtttgaggcgtaaccaagcccaagtgacgtgttacctgacgattcgggtcatacagaacctgctcttcttccgatgccaaatcaaaataaaccagccgactcggaatggtcatcgtactctcagtgaaaaccaccccacgatgatctggtgtcaatgcaaagtccgtcacatgacgccgaccatcaatcaaaggcgtcaaccgctcgtcaggcccgccagcatacagactcattttgccatgatcgaaaccacgagccagataataatctgccgtcacaaaatcggccactttaccggacagatcctgctgaaaatcactattaacataaccgggaatgtcaaaatctacatcatcggcaacgtcttgcaattcatgattggttaaatcatagtgccacagatgatcctgcgagacatttggcaaatgattatccgatcccaccaacagcagctgctgcccatcagccgaaaacgcctccggagacagtgccgcttgtggtaaatgttcattgaccattgtgattttttgactcgtcaaatcgaacaaataagtcgcctgactaaaatcattaggatcatccggtaaccgctcggctgcaaaagcaattttttgtccatcaggcgaaatcgctcccaagtcaaaatcatgttgccgtttcataaccaggtggctggttttttgccgccgttgctgtattcgcagttcataagtaacattttcctttagcaaaccaacaccattcagcttatacggggcgcgagtgaccgttaccggttgcggctttttcgcgtccgactctgatgattgcggtttagcgcctaccgttgtctgcagcaagagtgccttgctgtcaggttgccagccaaaattggtcacgccttccttttcattggaaaactgctgcgcgccacccccgtcaatccgctgaaggaagacttgcgttgttttgtcagctgcctgactaagaaaagccagccattgctgatccggactgacttgcggatgacgatcgtgcttctgatcaaacccgtaagtcgttttttggccgcggcgattgaccaaataaatgcgttgataataagtattatcttcttctgaaattcgattctcctgaacaaaaaaaccgcgatttgttgcaattggatacgacagcgataccaatttaaaaagatccgttgctgcaattgccatacactcacacccttctttgtcatgctttaagcgtagcggttgggctataccatgtcaatcaactggaccgctgaatttaaaaatgaatcaaatatttaaaaatcatcgacaggtatagccagcaaaacagccgacaaatgagacaaaacgtctcacttgccggctgtcagtttccgaaaatcaactttctatgatgaggtttccctatcattcataactgcgacttcttgagcttaagaaccttgatctcaacgcctaatgtgatgctttctttttggcgaaccacaatcctgagaacagactcagcaacgcacctagaatcaccatccacagagattgttgctcctctgttttcggaaggttgccttctgttgaggtgataacttttgttttaggtgctgcaggcttctcaggtgccttagtcgttggcaaaggtgttgctttggtgaccttttgtcccttgccggcacgatgttggtcgttaattgccttaatgccagctactttggcttggttcaccgcatcagcgttaccagctgcgtcaatcgctttctttgctttatcagcttctgcggcaactgcttgcttttgcgctgccttttctgcatcagtcaatgttggatcttgatcaattgccttgatgactttagcagcttcgtcgtcaattgcctttttggccgcatctttttgcgccgcgatggtttgaccggagcggtgctgggcatcaattgccttgataccagctgctttggctttgtctactgcatcggcaccttttgccgcatcaatggcttttttcgctttgtcagcttctgttgcaactgcttgcttttgcgccgttttttctgcgtcagtcaatgttggatcttgatcaattgccttgatgactttagcagcttcttcatcaatggctttcttagcgtcatctttacgggttgcaactgcttgtcctgactggtgttgcgcatcaattgccttgataccggcgtctttggctttatcgactgcatcggcactgccagctgcatcaatcgctttcttcgctttgtcagcttctgttacaacgccttgtttctgagccttcttttcagcatcagtcaatgacgaatcatgatcaattgcttcggtcactttagcagcttcgtcgtcaatcgctttctttgcatcgtctttacgtgttgcaactgcttgtcctgactgatgttgcgcgtcgatggccttgatgcctgcatctttggcctgatcgactgcatcggcactgccagctgcatcaatcgctttcttcgctttgtcagcttctgttacaacgccttgtttctgagccttcttttcagcatcagtcaatgacgaatcatgatcaattgcttcggtcactttagcagcttcgtcgtcgattgctttctttgcatcgtctttacgtgttgcaactgcttgtcctgactgatgttgcgcatcaatcgctttgatgccttcgtctttggcggtcgtaacctcctcgatatttttagcctgatcaattgcctgttttgctttaccggcttctgtcgtcactgcttctttttgctgtttcttggcagtagcggtcagagtcgggtcctgatcaatttcaccttgaactttggtagcttcagcatcaatcgctttcttggcttcgtctttgcttaagtcaaaagctttaccagagacgtgttgagcatcaatggccttaataccggcattttttgcttggtcaaccgctgaagcattagcagcagtatcaatcgccgctttggcctttgttgcttcgtctgcaacggcttgtttttgacgcttcttttctgttgccgtcagtgttggatcctgctcaatagcttggcctacctttgcagcttcggcatcaatggcttttttcgcagcagccttacgatcggtgagcgcttggccggactggtgctgcgcgtcaatgatctgaatgcctttggtcactgcttgatcaacgccatcagcattgtcggcagtatcaatcgcctgcttagctttcttggcctcgtcagcaacagcttgcttctgagtgcccttttcgctgtccgtcaacgttacatcatgatcaatggcttcgcttactttagcagcttcttcatcaatggctttcttagcagcatctttccggattgctagtgcttgcccggatttgtgttgctggtcgatcgccttgatgccagccttttgtgcctggtcaacggcatcagcatcaccggctgcatcaattgccttcttggccttgtcagcttcagcgatgacggcctgcttttgtgttgccttttcagcatcggtcagtgttgggtcatgatcgatcgcatcagttatcttagcaacttctccatcaatagctttcttagcgtcatctttacgagtatcgatgctttgtcctgacttgtgttgttcgtcaattgccttgataccagcagattttgcctgatcaatagcatccgcatttccagctgcatcaatcgcttttttagctttatcagcctcatcagcaactgcctgcttctgcgcttctttttgagcagccgtcaaagtggcgtcgtgatcaattgcatcagtaactttaccggcttcagcatcaatggcctttttggcatcttcttttcgtgcatcaactgtttgtcctgacttgtgttgctcatcgatagccttgatgccggctgtttttgcctgatctacagcatccgcatcgcctgcagcgtcaattgcttttttagctttatcggcttcagttgctaccgcttgcttttgtgcttctttttgggcagcggtcagagttggatcctggtcaatcgctttaatcaccttagccgcttcttcatcaatcgcttgcttagcgtcatcatgacggctatcaatggttttaccggctttgtgctgagcatcgatggcttgaatcccggctgtctttgcttgatctacagcatcggcatccccggcagcatcaatggcttgcttagctttgtcggcttctgtcgcaaccccttgtttctgggcagctttttgggctttggtcaacgtgttatcctgatcaatcgctgccgtcaccttggctgcttcagcatcaatgacctgcttggcatcggctttacgatcgtcaagagcttgcccggagtgatgttgggcgtcaatcgctttgatcccgtcagtcttggcctggtcgactgcatcagcctgcttagccgcatcaatcgcttttttggctttagttgcttcatccgtaaccgcctgtttctggcttgccttttcattcgcggttaaggtggcatcgtgatcaatagcagctgtttcttttgccgcttcggcatcaatggcagttttagcatcacgcttccgatctgcgagtgcctgactggattgatgctgagcgtcgattgctttgatcccatcactttcagcttgcttgataccatcagcattgccagctgcatcgatagtctttttggctttgtctgcttcagcgatcacagcctgcttctggtcagctttttgcgttgccgttaacgtcacatcttgatcgatcgccttacttactttggccgcttcagcatcaatggcctgttttgcttgctgcttttgcttgtcaagtgccgttgcggactggtgttgcgcgtcaatagcttcaataccatcaattgttgcttgaatcaccgcatcggcgtcagaggcttggtcaatggccgcttttgctttcgttgcttcatctgccactgcctgcttttgtgtagccttttggtcggctgtcaaagtgacatcctgatcaattgcttcactaaccttggctgcttcggcatcaattgtttgtttggccgccgccttttgcttatccaatgctataccagtttggtattgggcatcgatggttttaatcccgtcagccagagcttggtcaatcgcatcggccactaacgtagcatcaatagcagctttagctttagttgccgcatctgtgactgcttgcttctgtgcctttttttcagcggcggttaaagttggatcttggtcaatcgctttggttacttttgcggcttcagcatcaatagcctgcttggcgtcattttggcgcgctttaattgcctgcccagactggtgctgagcgtcaatcgctttgatgccgtctgttttagctttgtcgacggcgtcagcattttgccctttgtcgatcgcttgcttcgcgttatcggcttcggttgcaactgcctgtttttgcgccgctttttctgtcgctgtgagggtttcatcttgatcaatgttgcccgttactttagccgcttcggcatcaatggcttgcttagcagcggctttacgatcggcaactgcttggccagcgtgatgttgggcgtcaatcgctctgatcccgtcattcttggcctggtcgactgcatcagcctgcttagccgcatcaatcgcttctttggctttagtcgcttcatcggcaaccgcctgtttttggcttgccttttcattcgcggttaaagttgcatcctgatcaatggcagctgtttcttttgccgcctcggcatcaatcgcctgtttggcatcacgcttccgatctgcgagtgcctgaccggattgatgctggtcataaattgctttaactcccgcatttttagcttgatcgaccgcgtcagcattgccagccgcatcaatggcttgattggctttagtgacttccacggtaatcgcctgtctttgcactgctttctgggtcgcagtcagcgtcacatcctgaccaatcgcagcctgcaccttatcagcggtttccgcaattagctttttggctgcttctttgcgttcgttcaacgccaacccggcttggtgttgggcatcaatcgccttgataccatccgctttggcttggtccaccgcatcggcattcttggcagcatcaatagcagccttagcttgcgttgctgcatcagcgactgcttgctgttgcgttagtttttccgcttgcgtcaaggtcacatcttggccaatagctgcaatgactttaactgcttccgcatcaatcgcctttttggcatcttgtttgcgagtgtctaaaagcgtgccgctttgatggacggcatcaatggcttggatgcctgatgctttagcctgatcaacggtgtccgcatttttagctgcgtcaatcgctgtcttggctttgactgcttcatccgtaactttttgcttctgagtggctttctcagcgctggttaacgtgacatcttggtcaatggcgtcattaattttagcagcttcggcatcaatggcttttttagcatcaactttgcgcgtatctaaaagtgcacctgattgatgcccatcgtcaatggcttgaatgcctgctttttcagcctgaataacaccatcggcatcctgcgctttggcgatggtatctttagccttggttgcttcagcagcaaaggtctgcttttgggccgccttttcttggctcgttaaagtaggatcttgatcaatcgcttcgccaactttggcagcttcagcgtcaatggccgcttgtgcatcagttttacgcttagctaaatccattcccagccgatgttgcgcatcgatggctttaatcccatctgcttgcgctttggcgatttcatcagcattccgcgccgaatcaattgcggtcttggctttagcagtttcatcggcaacgccttgcttttgcgcctttttttcagcactggtcaaagtcggatcttgctcaattgccgttaaaactttggcggcttccttgtcaattgcctgcttagccttggttttctgggtatctaaatctgcaccaatttgatgtttcgcatcaatggctttaatcccatcagcttgggcctgaagaatggcatctgcgttttgagcctggtcaatcgctgctttggctttagccgcttcgtcagctactgcctgcttctgggcgtccttttcggtactggttagcgtgtcatcttggttgatggcatcggttattttggccgcttcggcatcgatcgcttgtttagcactatctttgcgggtcgccaaatcggtacctgcctgatgttgggcatcaattgccttgatgccatcatctttcgcttggatcaccccatcaatggtcttcgcttgatcaatggcagtcttagctttggtcgcttcatcaccaacgccttgcttctgggccgtcttgtctttggccgtcagagtcgggtcttgatcaatagcatccttgactttggccgcttcggcatcaattgcgtctttagcttgagctttacgcgtatcgaagtcagcgccttgcttgtgttgggcatcaattgctttaatcccatcatctttagctttatcgatggcttcaatcgtttgggcctgatcaatcgccgtcttggctttcgcggcttcatcagcaactccttgcttttgggccgctttttcgctagtagctaaggttgaatcctgctcaatctcagcagtcactttagccgcttcggcatcaatcgcctgcttagcttcttctcggcgcacgttgagtccggttccaggctgatgttgggcatcgattgctgcaatgccggcatctcgcgcctgctgaacccctgtttcggtttgcgcttggtcgattgccgccttggccttggttgcttcggctgcaacgccatctttttgctttgccttttccgttgccgttaaagtcggatcctgctcaatttcagcgctgactttggcggcttcggcatcaatatctcgtttagcctgttccttatgcgcgtttaaaacgatttcctgaatgagcttgtcaaagtcctcgtcaaccgtgattgggtcgactttttctttaacttcttcttgaaccggtttaggatccttggccgtgtcatcaatcgcctttttcttcatggcttctaaaagtttggcgttgagtgcaggaccaaaatcgttgtactcaagaatgcgagtggatcgaaatgctggatgaatagggtgtttcccttcaatccgattggtttccatccgaacagcaatccaatcctcgggcataatcttatgcgcctgcatgtagatgacggcatctgctcgtccacctagttgatgactaacgcttttaccatcactaccatcccagcgccgtgcaaattctctgttcttgttaagacttgtaataaccgctgggaccagcccatcaggtgaaatcacaacccgcttgatttttccttctaaggcatcgttaaacgaatacccaaactccaaataccgatccaagccatctgattcaagcgagccgaaccgaattggaattttgaaggtatccgtaccttcgtcatataccacggcgtcgttgctatattggaatgtgatgctatttataagcttcctatagctcgaaccatcggcaccacccaaatggatatcaccagcctggggcttattcgctgccaatacgacaccgcttgaatcccaaagaccaattgaaatcagtcccgtggctaatagtaatatcagtctcccctttttcacttcaacatgcctcccttttattgaacccaaaacagcaaacaattaagttaaccctacccattctcaaaatatttgatataaattattacattttgaaaggcgagttcttaataattgaaacaacaagcattatcactttataatttatggtgaaccaagcaatgcttatgcaatatgtcattagtataaataaatcaatgattggttctagttcaaagcttgcctaacgttaggcaagttttgatagtaacaacctacttggggaggtaagtttatggaagaactattggaaagtagcctgctcaagcactacgaaatcattagttttctgcttgacaaggaatgggtgaccattaagcaggtggctgaagaaacccggatcccggcacgcaccatccgccaaaatattggtaccatcaatcaatatattgccccggcaaaaatcgaaagtagccaacgctatggaattcgattggcttatgactcagcccataatcccttatatatctatgcagctatttatcgtcagtcaacgcgttttttgatactagagcaaatttttctgcaccattatttatcaattgctcaattttccgaagcacttttcattagtgaatcaacattaaaacgacatatgcaagttttaaaccagattctaccgcactatggatttcatattgacacgcaaaccctagatattattggcgatgaaaagaaaatccactttttttattacacttatttactagagagatattggtttatcgatgattttctgccacaggatgaattaaaactaattgctgctatcatctcagagtttttcgcacattatccgacactgacaacccccagataccagtctttttcttttatcaacaagttacgcgcgacgatcttcgtttgcctcaaacgcaacagtcgcgggcacacgtttgaaaatgcgaccccggcaatcgaaaatgcaaccttctcgccagaactgcgccaatcaattgcacgctgctataagattgactgctcctcattagttttctcgcatctgttctatctcttttttaatcctcgaaatgcttggtcttacgccgatctgctcactaaaacacatcaggatgctgaaattcgcgcgatccatcgcgcacttacgcattttcttgacatggtcgttgcaactgaacatctatcgttaccaaatcgcgaacaagttctactgcgcttgtataacgccatcgaatatacgtggggtccgacaaaaatcctgtacagtccgagcgaagctttctttgcgagcatgaaccaatttagcaagacttttattcgtcaggccagacagacactggttactgcactgagaaatgaaaaagtcaacgttcgaattgatgatgctttcatcaccaaactgttatttactttggtgacatcatgggagacgctgccgctgcaattagagcaaaaagccccgaaagtccgaaccgggctcttcttcaatacgagttttgagcatagtcactttttgctgaatgaactcaattaccatttacgttcgaacctcaaactcgagcttgtcccggccagtaccttagcagagttaaaaaccgttgcccgccaatttgacctgatcattaccaatctccccttactcaatttgccaaattgccaggtggtcgccattcagcctcatcccacgccggaagacttcgataatattttggctgcttataatcggattattaatgccaaaagtctggaaagttccgtatcgtaagctcccaacgacttttcacggaaccgaacgcatacaaaaatccgtttgacaaaatcgctatgtcaaacgactttttgcttctgatcggtctgatgtcaatccgatatttatgaaatggaggagataggattcgaacctatgaacccgaaggagcggatttacagtccgccgcgtttagcctcttcgctactcctccatgcgattgatataaatcaactttaatagtgtacaaaaagaggttataaaaatcaaccattttcaggtagtttttataacctccgatacttaattttttgcttaatctgtcaaagctgcgggcacttccaatgtgactaatgtgtcgcgccattccgtcaaccagtctgtactttgccattcaaaaaggcgtttaagcccatagcccagcggttgatgataataagttgtcttgcctagcagcttaggggcatcgcgaaaatgctcatgaccaaacaccacggcactagcccgatttgtcaacagatcgcctagttttgccgatcccattaacgcggtagccatctgccatgaccggcgatcaactgcgtacaccatcgcaccgagaatcggaacaaaatgcgtgacataaatgatccgtttgccgcgattggccaccaaagccgctttggtggtatcaagcacccgctgcatccgctctaagtcacttatcggtgagtcaatggcgctgtcgatccaaaacgctcgcttccactgcgcatattcagccgacgttttcgactttccaagttgcgcaagtgaataatcataccaaccgttgtttccaacgataaccgcattcgttcccgggactgacaaaaacttttcgtgtaaataaagcgggtcaacatctgactgaatttcagcataggtcgcacccttaaccatgtcgtgattaccagctaaaaagcggataatcacttgatcgccgacttcccgttgcaatgcctgatagtacgccagcgtttttgtgaaatcgttatacgtatcaccggcattgacgtagacttgatagccatgttcaacgagataggctgcttggtgtttcaacatttcgaaaccatcaacatgattaacgtcaaaatgattatccacgctgatcgcaacttttaccatcaccacacctccgttaatttaccggtgcgcgccagcctatcacccgcttaattaaccccttgcatcagcttttcaatgcgcggcgtgaaaaaggccagtacaatcgcaaagataactgaaaccaggccaacgacagcaaaataggcaacttcatggcttggtgtatagaaacgcacaatttgcgcattgacggcctgcgccgatgcatcagctaagaaccacatgctcatcatttgcgatgaataagctttaggcgccaatttagtcgtaactgaaagtccaaccggtgaaatcagcatttcgccaatttccacaattgcccagctcatcaccagccacaaaggtgaaaccttagcactgctgccaaataacaggaccggaatgaccatccataagtacgacgcgccggcaaaaatcaagcccagataaaatttcttgggcgaggtcggttggcgtttaccgagtttcatccataaccaggcaaataatggaccatataacagaatgaataacggattcaacgtctgaaaatttccaggcaggattttaaagaatccaaagtccaatttagtctgctgggccgcaaacaaagccaaaacaactgagccttgctcctcaatcgcccaaaagatcatcgcggctaagaacagcgggatatacgcaatgacacgtgaacgctcagtcttggtcacctttttgctgcggatcatcaaaataaagtaccaaaccggcaagccgatcgcaacgatggtgatcaaactaataacgtttgcaatcgtcaaagcacctaggcttgccatcacggctaaaataaccgcgacaaccaccaacgcacccacgacgcgcatcaccagcggccgaatatcttccggctttaacgggtcaggcgccgtattgtcagccggattaatatatttacgcccatcgatgacataaaagatcaggccaataaacataccgatcgctgccaacgaaaaaccagcgtggaagttaaacttgtcggccatccacggcacaaagatcggtgcaatcaacgacccgaagttaatccccatgacgaagatactgaaaccggagtcccggcgcaaatcttcttcaggatacagactgccaaccatttccgatacatttggtttaagtagtcccgtccctaaaacaatcagcacaatggagccaaataaccccaccgcgccaattggcaaagacaacacaatatgtccgagcatgatgaggacaccgccccaaaagacagttcgccgcgacccgagcaagcgatcgctgataaacccgccaattgtggcacttaaataaaccagtgatccataaatcgacataatcgataaggctgtgggctggtcgaatcccagaccgcctttttctaccgcatagtacatgtagtagattaagatcgcccgcataccgtaatagctgaaccgctcccagaattcggtcatcgacagcgttaatagcccgcggggatgacccataaacgtgcggttctttgaattatccaattgaaatacatcctctcgctaggaaatgatcctcctagctgctctcatgacacttccctcaaaatgtcaattgataagtaatcattatagaggtattttggcatgaagacaaatgaaaccgcaaacatgactgagacttctatgccttcatagcattttcaaacctaggttccctagctttttacgctcaagaaagatcttcttcctcggtaaagcaaaaagcagaggtgcccactgcagacaccactgctttctagataaaccatcaattgttaatcgttatagacatcagtcagctcgtaaagcaatcgctgcatctttgtttgatgccatacgcgctggaatgtggccgccgaggacggtcaggatcgtgctgattagaatcagaatcaccgcatgcacgggattcaactgcgcaacattcggcagttcggtcatgccgtacaaaatcgcattgatcgggaacgtcagcaaccaggcaatgataatgcccagtatccctgaactgacccctagaatgatggtttcagcatcaaaaacccgggtgacatcttttcgacgcgcacctaatgccttcaagacgccgatttctttggttcgctcaagtactgacgcataggttagaatcgcaatcatgatcatcgaagttaccagtgaaatccctgcaaaagcaaccaggacaatggtaatggctgacatgatcccgcctgtcatgctcgaaatggtgccggccaagtcagtgtaaaccacctgatcggcctttttcttaccatggttgaacttgtcgagataactcaagatcttgtccttatccttgaaactagttggataaatcgtgatctgcgtaggcgtttccgatccgcccaatccggtaatcagttgatccttggtggcatcatcaatactttgattggtgaaaatattaacgtcactatttcgttgtgctttgacaactgccgaattcttattcattgccactaaatctttggtcaaccgatcagaataagcaaaaccttggctcaaaagaccatcgctcgtcttggaacgggttcgcaaaacaccggttacggtcagctcccgattaccattttgattataggcatcagcgtaatttttagttggtacatagacgctaccacccacattttgataataatggtcattggcaatcgcctttagcttcgtcccgacaatgtcgccaaatttgattttttgaccatttttaactgagaagccaaggtttttcagcgcattgatattagtcgaattgtcccgatcaacaattaaaatgacgtcattgtcggatttcggatagctaccggcgacaacctcatagttcttcttgagatagcttgtcttgccttcacgatctacgggataaacagatgaactggcgctggaaaaactccgctgtgtttgattgctcgtcggtttggcggttgaaaattgaaccggcttcaccgttccgttgacattacgcaacaaattcattccggtgccatacgtataaccgatattattcgtcaatcgcttgctaatgccattcacatagtcgatatacttttgattaagtttgttggtgtgctgtgctttatcactggcactttgcttggcttccaccgttttagttgtcttaaaggtggaagttttcgtattatcttccgccccggctgtcaagttcacggcagtagacgaaatggtaatgggaaattgcgccaacgtttctgactgcgtgttatcgatttgcttttgaaaacccgaagaaagggccagaaccactgctatcccgataatcccgatacttgatgcgaatgccgtcagaaaagtgcgacccttcttcgtcatgatattggtaaaagataacttcagagccgtcagatagctcattttagtgcggcgtaaatcaaagtgtccggtttgctcctcaacatcatatggttttgaatcagatagaattttaccgtctttaaattcaataatgcgttgggcataatcatgcgccagttgaggattgtgggtgaccataacgactaaacgttcccgcgacaagtcggcaatcaattgcatgatttcctgactggtttcggtatccaacgcgccagtcggttcatcggccaacaaaattgacggttccgaaacaatcgcccgcgcaatcgcaacccgctgcatttgccccccagacagttggttaggttgttttcccatgtgttccttcaaaccaaccttaactagcgctgcctcagcctttttgcgccgctcactggcagaaaccccgctcaacgtgagtcccaactcaacattttccaaaatgctaaggtgcatgattaagttatagctttgaaaaatgaagccaaccgagttgttacgataagcatcccagtcagattctttgaagtctttggttgaccggccatgtaacaataagtcgcctgaatcataacgatcaaggccaccgatcacgttcagtagcgttgttttaccggagccgctgggaccaaggatggccacaaactcctgctcccgaaactgcaccgaaacatcatcaagtgctttcgtggtgtaatcaccggtttggtaatatttttttatatgctttagctctagcaaagaccattctcctctacaacaagtgacaacgcgccgaaatgaaataacttgccatatcttagcatacttacccagcacttgataatcggtctaaagcccaaaatgaaaatcagtcccgacttggcacccattttggcgaaaaaaagaccgaatcatcacacaataccttgccgattcggtcaattcagtcacgccatccgtctggttcaggattggactttcatcagcggctgccaataaattaagtccaagctatgatccggatagatgtaataactgatatttaattttgaaaaaggatttgccattgccattaagtaaatgggttgcggtgcatgcgccaatccagcaactgaaacaagaatgtacttggccatctgttcaaacaggggttgggtcaacccggttgttagctcaaaatccaagtcaacgtaaatcagctcttttgtttgtcgcgtgaggctgatccgatgaatgggtaatccgccaaaattaccgtcttgattgagttcatcgaccattcgtttaatttcctgatgcttaaactgcggccgtgcaaacatcatgcgccaaattgccaagtcgtcacccccttgcctcaattatgccacattgacgcaagaacgcggactaaaagatcggatcaagaatcttggaaaaagccgaatcaatttgagcccgagctgcttgctgttcggctaatccggccgcaaatcgttcatgatctacctgatccgtgtcgatcgcctgcaacatattcaaaacgccgctgcgaataccacaaagaccacttaccaataccttatgaaaggcagcatagttgcatggtgctgactcggcattgacactatctacaaaattacagaacttaatgacatttttggtgaaataaagtcgcaagcggtcgagactttcgcttgcatagcagtttcttttctcgatgttcttgcatgtgtggacgtactctttaaaaacagtctcaaacacgagaaggcgttccagattttgattaattacttcaacataactaggctcattgcttactgcatacatttaaaagtccctcctaatcttgtgagttcatcaacttacagacttaattatacctgttaatggcttataatcaatataattacatgctaatatttaaatacctaacgttatataaccgctacaaaggccattattattgggatttgcagacatgacaccagtctgtgaaaaccgttttccctgacattgcacgcaatgtatctatttgtgaaaacttgttttatctatgccttatcaccctgtcttgacagggtgatttcttgaaggcagccatttagtatctacttgcattaaaaataagataacgaaaatattttttggatattttgcatttatattttaatattttccaacaatcgtgcaaatcccagccataaagattctaattgcagggtcggttataaaacgaagatgtttccaattcgaggcagttaatagcatgttttaaaaacatcacctataatcgagtcaagaagcctgcaagttaaaaatcttatggtcaaaactcaaaaatcgagttgcgaaaacctttttaatttgtcaccgcacttatttgattcttgggaggattttacattgaagggttatccaaagaattaccccttagattcacggactttcttcggcgttaatgccatggggttgatcagcacaaccgcgtattatctttatactgctgttttgatgatgtttattaccgattattccgggatttacaccaacgtccctggcaaagcagcggcagtcgccaccacgctattattcgttggacggctctgggatgccatcaatgacctttggactggttatttgattgacatttcacccagaactcgttggggaaaatttaaaccgtatgttttggttggaaccttttttaccggtattttgggcatgatgttgtttcacattccccaaaacttaagtgatttcggcaaagaagtctacctctacatcacctatttcttatttatgttttcagcaaccattatcgtcacggttccgctgaccagcaccatgtccgctgatcaggaaattcgggctaaattaatttcctggccacgaattaccagcaatgttgtcggtgtggtcttcgcgttttttatggcgattgccagcttcttgggaactaagaaaagttcaaatattccattgaccgtagatttgatcatcattccatttttaatcatctcgttaattggcggcttcatggtcaaagaagggcctgttgcggaaggaaccaagccgccaaagttacgtgatgtcggacggatggtaaaaatcaataagccatttcgcgtcaatctctatttcacttttgttggcggctttgtctgggcgttactgacggcaacatcgctttactacattaagtacgcattcggcgttgccaacttaggtattcagtccatgtacttcgggctcctgaccttagtcaccctaatcggcggtacgttaatttcccaaaaagccatgaaatatatgtcagcacttcgaggcgttcaaatctgctatttgggaatggttccgtttctgctaatcatgtttgcgatcaatgaatttcaggtcattcataatccttggcttttctatcttcttatcggaattgtcatgaccctagccggcgcccaatttgtgccagctaacctcatcatcatggaaaccatggattataatcgacttaaactcaattcgggaatggaagcaacgatcaatgcggttaacatgtttctccaaaagctgcagtcgggtttggcaacaattggcgttggattagccttattgttagttggctataatgcgcaaatactggaaaaagccacccgcatccccgacagtttgcttaaaagcctgggggtagttttattcggtttacctgcagtcttttcgcttgtagcttatcttttaacgaagcaatacccattgcaaggtgaggcgcggacccagatgtatgcggaattggccgcgaaaactgcagctgcaagtcaaaaaaaaaataagcaggtctaattgttagttacttgaattgagcatgctgttacacgctcacatcataacgcgctccccggcgcagaagtcggagtgtaaggacctcaggcgcaatggccaaagaccggccatcacgcctgaggccacttacactccgacttctaaccgcgccggctcgcgctcactggaggtatagtttatggttaaaccatcacctgtcaatattcaccgcgacgatccccctgcttggtttaaacaagcagatttcggcattatgattcactgggggctttatagtgtcccggcttttgcgccgaccaatgtgccggattatgatactttcatcaaaagtaagccgctgaagttcttttttgctaatcaaccgtatgcggaatggtatgccaacagtatcttgtttcctgacagccccgctgcccgttaccatcgtgaacattatggcaatgcgccttactcggactttgccaaaacgtttaagcaaagtgcccagcaagtcgatgttgatgcctgggcggatgcctttgccaatgccggcgcgaagtatgtggtcattgtgacaaagcatcatgacggatttgtgctgtatgacaccgacgtagcgaatccgtatcaacctgattatcaccttgactttgatttcgttggccaattagcacaggcagttcgcgcccgcggtatgcatttcggtacttattattcttcattgttagactggaccttcccgcacgtgcccatcgctgattacggttcactgatgttaggaaatgaccgatcaaaaatttataaccagtacgcacgggcgcactggcatgaactgattgaccgctatcacccggatattttgtggagtgacatcggctatcctgacgatccgggtttgcctgacttattcaggtattactacgatcaggttcctgacggcttagtcaatgaccgctggcgccaatttcccaactggctgcgcaataagccagggcgggcggtttttaatatcgccgcaaagtacgtcatgaaccaagaacacaaacatcccggtgatgtcggcgagctcaaatattacgattatcggacactggaatataacagtgactggaaggaaaataagcgctacttcgaaatgactcgcggtatggataaaagttttggctacaaccaattcagccaatctaaagactacatcacaaccgccgcagtcaaaaagctgatcgcaacactccatcctaaacgtggccgtttactacttaacgtcggccccgatcgctatggcaccattccaccgtaccagatgaaaatactgcagcaacttagtgatcgttaacgctccaatccaaaacgtattaaaccgagctatgttcagtcatcaccacaacaaaaaacgctaggaacatcggccactgtcagacggtgcgattcctagcgttttttaattcagattattgaaccagcccttcagcagggtgcgcttaatcatggcgttaaaaccatttagctcagctgattaatcgccgcccagcttgccaatgcttctggatgaaagccgctccaagtagccagcacatccccggtctcatcgtcacgaacacggacaaccggaaaccgatcataaccatccgctcgaaatttaacgactttctgggcactccaagcacgtttcaacggatcttccgcactcgtatccaccaagttcgattcaccgcgctgattcgtggtgcgaaaatgctgatgatgagccagcaaccagcgtttcgtcaagcggcacgattcgcactggggcttttcatataccacaaagtgaatagccatacgcatttcctcccttactcatgcttatcctcgatctgggtctaaagcgcatgtctcattttgtttctactatcccttattccggctatttttgcaatgacaactcatcaaattcagtgtgcacatggctgtttggaaaccagccgtaccagcattttcaagaatagcaagcaggttccccttgataggccgcttgttgctcctgggcgagccgcttttacaggcatctgattatgatcattcaactaaggcagccgcgactttttccaaagcctgagttgctgcaagcggtaagcgatcatacccgtcagccactgttgctttatcggctaaaaatgtcaagcgatcatccaatcgttgccgtaataaggcccgataagccgaattgctaaagtccaccgcaaaatttggcaggctcaaatagcgcatggcaggcaatggaccaaatggtttaaacgccgccgtcccatccacaatcgcggcaatcgcatccaatgtatcgcttggtttgactttttgtccctggaaaaaaccggtattaagaatgtaacaagccatgccgcgttgctggaacaaatcatagaaatcctgataatcctctcccagcggataactacgaaaaggattggcaaacggttcaatgaccaactgttcccgatcgacatcggcacgcacattttcggctgtggagcgtttagtggccaaagttgccccaaaagctgcggctaagcttggatcctccactttgacaaccggcggcaaagcgtcatctttcatgatccagaaaatggcgtcaacgctctccaccaaatgatccacccgattaggcgtcacataacgcgatttaacggtccgaccattcccgttacgaatatcttgggtcaccaacgtcttcttaccgtgatcatccagcgtaacgccaacattttgaaccgttagaaaataacgcgtattcgggtcgctcattggataatcctgggttttatcaaaatatgccggttcaagcgcggtggtcgcaccggtctgccgatcaatgacaaacgcatcatcgtgtaacaccttaaccggataccggtcaccatgactggtcagggtgatggtggacttgccggagcctgacaagccaaacgctgccatcgtgaaggtaccatcttgccgctgatactgcttcatcccgccatgacaggcaacaaacccgtttcgatgcgctgttgcccaagccagtgtcagcgttcccttcttcaattcgccaaaataccgcaagcctaaaataatggcggcattatgcaacggatcaaaaattgccaagccgtccggataatccggatgatgccagtcaggatcagcataaagataaagatcatcttctggaagcggccgcgactgctcatattgctgcgttgcttcaggcgttttaatctgaaagttcagcaaataagtgtaaaggttgttggcgtaggtttccggcaccatcaaatgcgcctcaactgcgaaatcagccgacaagccaacaaccacatgtccactcaaaaatgatttgcgtgtacctgcaaagaccgcctcgcgtgcaattttcgtcagctcagcagtatcaaccccgggctggccgatgatacgacgtgcggctgccgtgcgccccaccacctgtccgtcatttgcaaccagaactcgggcatcttcaggcaatccaagctcactggcatgttgaaccggcaaatcggttacgatgacaccaggtgcttttttagccaacgcataggctgctgcaatcgtcgtcaccgcctgaacattgttaccataaaaagccgtttcgaccgttgccttgagcgcggaaaaatagccgcttgttgctgtcacatcactgactggaaacttctgcttactcgtcatggttgcatccccctaaccgctcggattctcctcaaaattcaccaaaagaaaaacccgaacttcatccatttgaaaaggctttcacaacctgattatacagacttgtcgcaaacaacgcgaattttaaaatagccgctgcagctaaaaattaagccgtaagcatcacccaacaaccgttacgggtagggttggataaatcccgtcgcctaagctttacgctgcttgttggcctgcatcactttagcatgatcaattaaaggacagccaatatcttcacactgactgcagccgcctgctttatttttacggaaaaaggtccggtacaaaaccactgcaatcgtcaacacaactaagctaccaattatccatgttgccatgttcaagactcctcgtatatttaaattacaaccaagttttctatcatgactggttcaatagctcgcagccattgccgatactgggcgcttgagccacaaaccgtaaatgatgagtcctgctgcaagccctactaatacgatgctcaacccacctgcttggccagtgaaaatcaggctgctttgataaaccaacatggtcaataagtacgccaccccggtttgatagccaacagcccaccatgtccaccgcgcatcgccaaattctttatacatcgttccaatagccgcaaaacatggcgcgcacaacaggttaaacatcaaaaatgcataccctgccatcgctggataagtcgcgcataacgtctgggaaaagctcccggaaccactagcaccaaaactaatgtgcagggttccgacgcaattttcttttgcaatcaagccggctaatgtagcgaccgttgcatgccaatcaccaaaacccaatggcgcaaacagcggtgccaatatgccgccgattgctcgtagcatactgtgattttccgaaaccatctgcaaagtgaaattaaagttcgacaaaaaccacaacaagacacatgacagaaaaataatcgttccagccttatgcacaaatgcccgtgcgcgcgacatcacactgcgataaaggttggtcagccgaggcaaatgatacgccggcaactccatcacaaacggtgcaggcgggccggcaaataaagccgttttctttaagaagatgccggaacaaacaaccgcgacaatccccatgaagtacgctgacggcgccacccagctattgttggggaaaaatgtgccgctcaccaatgcgatcacggttaattttgccgaacatggcataaacgtggtcaacatgatactcatgcgtcgatccttttcactttcaatggttctggtcgccataattcccggaacgccgcagccagtcgcaatcaggatcggaataaaactttttccgcttaaattgaaacgtcggaacaaccgatccatcacaaaagcaatgcgcgccatatagccacagtcttcaaggatgcccagacacaaaaacaacatgataatctgaggcaagaaccccaagaccgacccaatgccaccgattaaaccatccacgattaaaccggataaccacggtgcaactgcccagcttttcaacgtcccgccgaccacactcggaagccagctgccaaacaccgtatcattcagataatcgctgccaatggttccaatcgtctgaattgaaagataataaaccgcccacataacgacaacaaagatcggtaaagccagatagcgattcgtcacaatccgatcaatccgatcactcatcgacatcacaaaatcatcttgatcaaccacacacatggcaatcacccgcgcaatgaagtcatatcgtgcgttgacaatgatgctgtcactggcgtcttcaaaaatatgctccgccgtatgtaaaatctccgtgacctgtttttgctctgcaggtgaaaaagccaatttttccatgacttgcggatcgttttcaaaaatcttgattgcataccaccgcacccgttcttggggaacacgatcgccaataacttctgccaacatcgttaaggctgattcgagtcgcggatcgtactcgggaaacgtatacggcttcggtagcggtgcttggatggtctgaaccaattcctgcaatgcagcggttttagttgcattcgtgccaataacgggtacttggagtgcataacttaattttttcaaattaatgctgcgatggccgtttttttccagcacatccatcatgttcagcgccacaatcaacggccgaccagtctccatcacttgcaacgttaaatacaggttacgttcaagattggtggcatcaacgacatttatcaccagatccggttgattgtcgagtaaaaaatcgcgggtcacaatttcttcgctgctgtatggcgacaaggaatacgttcctggtaagtcctctagcaccaaggcatgattggctttaagccggcctgatttgcgttcgacggttacgccgggccaattaccaatatgctgtttagaaccggtcagcgcattaaacaaagttgttttaccactgttaggatttcctacgagtgctaaagtttcatgcatgtccatcggcacccacctccgttacgagcacatgagctgcatcttgcttgcgaatactcagcttataaccgcgaaccgcaagctcaatcggatcacctaaaggcgcaatttggtgaatcttaaccagtgttccctttgtcaatcccatatccatcaagcgatgacgcaacgggggatcacccttaatcgtgcgaatcaggcccacttgattcaaagctaactcccccaacgcaacagcaggctgatggtcatccatggcaaacggctgcaccacgagtaaaccggcaatctcatcactaatcgccaatcgctgtccttggaaaaaaataaccaacccggtagctttatttgcaggctgcaccaccgtcagcttcttaacaatcgcaagtcccatttcagcaagatggcgccgcaaagcagcactccccccgacactcatcaatagataagccccggactgattaacatcaagcaatgcctgcatataaaccacctccaaaaatgagtgagcgcgacccagcgcggttagggatcggagtgtaagcggccgcctttgaccattgcgtacgaggccttccacgcaaactcctgcgtccggaaacctgttccacctgttccagaatcaaacgaccatcaacaaagctcatcgtcatacaaagccaacattttcgccaatcgaactcgtttatttctttactttgatttcgctaaaaccgctttagcaactgtcgcaacgtaatgcagttgcccctcagttgtcggatgggttttatccgctgtaagccaattatcgtgtcccgccgaagcagcataccaatcgacaatatgtaaattcgaataacgttttgccattttcacaagatcacgattaacttcatttgtccacttggcatctgaacgaacattgatccaatacacctgtcgcttactgccaatactggtcataattgactgaaaagcttcatctgtaaacgtaccattcgtacccaacccaataataaccgtatcggctaatctaccagacgccgcgagtgacttaaaaagctctggcgcctgataaatttgccggctaaccgttgcgtccagatcaaccttggggaagatttctttatacagataagcgctacccagcatcactgaatccccgactgctgtgatcggcatctgtttagcgacttgaacctgatgataactaagtccttcatcagcaaaatctttataaaccgggtcttctgcctttcgggatgacgcctcggcttgactggctttggcaaccgagcgtgaacgcgcaaccgaacgcgctttaacccgcgatgatgaggctgcctgctgcgcccttgcttgcgcctgctggttaagtccaaaccagatacctccagcgatcaagaccacagctagtaagacaaccggccaaagccacccttttgttaaacgtgttctttgtctatgcatctcgcaccccttcgatcattttgttaccgtttgatcatagcatatataagcgcctaacagggtcgaaaattgtatcgaaaaaaggacttttagactctggcacttttagaattcggctacatttaacgtctcaaatagaagcagctatctacggtttttttggcacgttttaccttaagaactgatatactaaaaagcaactagctggttaacagttagcactcgtttttaaaaatggagatgaccagcgtgacaaaaacactatatttgattggcggacctatgggggccggtaagacagccgttagcgaacaactggttaagcggttgcctcaagcggtgatgctagacggtgactggtgttgggcaatggatccatttgtggtgaatgatgcgaccaaagcgatggtaatggataatatccaccatttactgaacgcgtttattcaagcaccggacttgattaatattgtgttttgctgggtaatggacgaacaagaaatcattgatgatgttttgggtggtttgatgctgaaaaatgttcaagtggtaaatgtatcgctgatgcccagtgcagagaaattaaagcgaaatattactgctgatattcacgctggcattcgaacggcggatgctattccgaaggccattgcgcgattgccaaagtatacaaccgtcaatagcactaagttggatacaacggctcttgtccccgcccaaactgcggcaatgatcagcaaactatcccattaagctgattcctgctgtagtgatcgccgaatgtaaggtcaaactgatttatagccttgtacaaaacttttgtggcattttagaatcttttctaaattcgcaaacgtctctgtagaatctgaaaaatctaaaataattttgtcgcacaaaaagtctttacagcgcaatactgctcctgtataatcttacttgttgttcagcgatggcccgttggtcaagtggttaagacaccgccctttcacggcggtaacatgggttcaaatcccgtacgggtcattatgccggcttagctcagttggtagagcatcggtatcgtaaaccgagggtcaggtgttcgagtcacctagccggcatcatacaacttaaatcgcagatgcactggtaaaaccagtacgtctgcgatttttttaatcaagttctgatccggaaaaccatcatttttgcgccaatggccgtttaattttcaaaaagaccactattaagggcttacaaggtggtatgagtcatcaccaatttcacaaaaacaaatcagtctgaatgcggattagttctatatattgatgtcaattgtctttaccgttgtattgttaactttctagtatttaaacaaatttgcggaaaaagatgactaactttagacttgtttaattgtctatctacttttagtaagtgtatcataaacaatgaaacgactcgccacgaaaggatgttgtgatacatgaaaattgcgattattggtgctaccggcaatgcggggtcggctatttttaaagaagccttgaaacgcggccatcaggtgactggctatgttcgccacccagacaagggagttggcatcttaccaccagacgcggaattaatacagcaagacgcgtttacacttacgcacaacgaattacaaaattatgatgttgtcgtcgatgcttttggcaccaccgtggaccaagcctatctgcacatcgacttggccgaccacctgattcatgaactgcgcgagactacttccccacgcatcgtttttattctcggtgctggcagcctagaaactgacggaggacgtctctatgacttgttaaagaaagacccccacgctccttccttcatcaacacgcctaagaatcagctcagagaatatcagttgttgcaatggactgacaacgttaactggctgggtatttcaccaagtatgatttttcaacatggcccggcaaccgaatacgtgcgcggcgacaatacccttttaaaagacagtcagggaaagtcggtattaaatagcggcacattagcagtagcactgctggatgaattagagcagccaacgattaagcaagcacgctttactgcccgcaatgcttgataagtgattttcaagttcaaaaaggatgaggatcaattgatacaagtcagactaactgttcattatattgatgaaaacggtaaagcactaggtccggataatcacttaatgaactcgagagaccatcattttcgcctaaccgcaccgccattgattggctatgattttcaaaaagcaatccttcctaatggccaacatgttaaggatccgactgtggctggcaccatgagcggcgaaaccccggagcttacctttgtctatacaaccgccgactcgctcatccaccaacctaagccagccacacttgtgattaaataccttgatagtcaccaaaaaccgcttcgtgatgtgcaagttctacacaccaaaaccggtcatcaattcaagcttaccgcaccgaacttttcagggtttcattatcaccacgcattgcttcccggaggtatggtgatgtccgataaaactgtcacaggacgattaatccgatcacataacgagctgatttttacgtaccagccaacctaaggcaacaattccaataaaatagcttcgatctgactgttaatctgtcatgatcgaagctattttatgttattgctggcccgttaagatactctgcaatgaactcgtatcaccttgttgttgcaatgacttggcatcttgataggcctgataataatcaccagaagcaattgcctggcgaatcggtgtcaccgactgttctttaaagaggacagttgcagctaactttgcttgatcctgattaacacccgtcgccttttgaagcaatgtagccgcctggtcctgatcctgcgcagctttcataatcgtactcattttcgtttcttttatcgtatcagctgctcgctgtaaaacagcatctgttgccgggttgccggttttttgagcagtaatacctgacacaatccgtgctttaactgcactgtcagctggtgtgtcgttaccagtgacattgcgaatcgtgttattaatctgcggaaagaaaaagatcccgcacacagccattagtacaataagacccgcgacaatcgaaaaaattttcaagccacgatgacgatgctttttctgctgacgtatttgcaatcgtttatccaaaaatgacactcccttcacttacaaggactcatattaacatgatgccaattcacgcagaggcggtcaagctagtgaactttagtagccactcgttgttaaatttcccgactcggaatcataggttaatgcaagccaaagtcacgagaccatttacccttctgaaaataatatagaaaaaaggcatccactcattgatggatgcctttatgagctccggttgtcaggctcgaactgacgacaacctgattaacagtcaggtgctctaccaactgagctaaaccggaataaacagcgtggcagcttcctaccctcgcaggcagtttcccaccaactactctcggcgtgaagaagcttaacttctgtgttcggcatgggaacaggtgtatccttcttgctatcgccaccacacttatgagaactttgcgctctcaaaactggctatcattgttgttgtttttgccggaacttaacgtatttcatcgaaacgcgcgcgctggcttagcaccagtttgcgctttacttggttaagtcctcgaccgattagtactggtccgctccatgcatcgctgcacttccacttccagcctatctacctgatcatctttcaggggtcttacttccatataggaatgggaaatctcatctcgaggggggcttcacacttagatgctttcagcgtttatcccttccgttcatagctacccagcgatgcgcctggcggcacaactggtacaccagcggaacgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccagggtagcttttatccgttgagcgatggcccttccatacggaaccaccggatcactaagcccgactttcgtccctgctcgacttgtcagtctcgcagtcaagctcccttctacctttacactctgcgaatgatttccaaccattctgagggaacctttgggcgcctccgttacattttaggaggcgaccgccccagtcaaactgcctacctgacactgtctcccgccacgattagtggcgcgggttagagtgttcatacagctagggtagtatcccaccaatgcctccatcgaaactagcgttccgatctctacggctcctacctatcctgtacaagcggtaccaacactcaatatcaagctacagtaaagctccatggggtctttccgtcctgtcgcgggtaacccgcatcttcacgggtactataatttcaccgagtctctcgttgagacagtgcccaaatcattacgcctttcgtgcgggtcggaacttacccgacaaggaatttcgctaccttaggaccgttatagttacggccgccgtttactggggcttcaattctgggcttcgcttgcgctaactcatcctcttaaccttccagcaccgggcaggcgtcagcccctatacatcatcttacgatttagcagagacctgtgtttttgataaacagttgtttgggcctattcactgcggctgaccttgcggtcagcaccccttcttccgaagttacggggtcattttgccgagttccttaacgagagttcgctcgctcacctgaggatactctcctcgactacctgtgtcggtttgcggtacgggtagtttatttctcactagaagcttttcttggcagtgtgacatcaggaacttcgctactttaatttcgctccccatcacagcttgtccttaaggcggcaagcatttcactcgctaccggacttactgcttggacgcacttttccagccgtgcgctttccttagcctcctgcgtccctccatcgcttaaacaaaataaactagtgcaggaatctcaacctgcttgtcatcgactacgccttgcggcctcgccttagatcccgactaaccctgggaggacgagccttccccaggaaaccttagtcatacggtggatcagattctcactgatctttcgctactcatgccggcattctcacttctaagcgctccagccgtcctcacgatcgaccttcaacgcccttagaacgctctcctaccgcgcacccttacgggtgcacccacagtttcggtattatgcttagccccggtatattttcggcgcagtgccactcgactagtgagctattacgcactctttaaatggtggctgcttctgagccaacatcctagttgtctgtgcaacgccacatccttttccacttagcataaatttagggaccttaactggtgatctgggctgttcccctttcgacaatggaccttatcgctcactgtctgactcccggagtaagatcaatggtattcggagtttatctgaattcagtaacccttgacgggcccctagttcaaacagtgctctacctccatgatccatcctccgaggctaaccctaaagctatttcggagagaaccagctatctccaagttcgtttggaatttcaccgctacccacaactcatcccagcatttttcaacatacatgggttcggtcctccagtgtgtttcaccacaccttcaacctggtcatgggtaggtcacttggtttcgggtctacatctacctactgaagcgccctgttcagactcgctttcgctccggctccgacttttcatcttaacctcgcaggcaaacgtaactcgccggttcattctacaaaaggcacgccattacccgttaacgggctttgactaattgtaggcacacggtttcaggaactgtttcactccccttccggggtgcttttcacctttccctcacggtactggttcactatcggtcactagggagtatttagccttgggagatggtcctcccggattccgacggaatttcacgtgttccgccgtactcaggatcctgaacggagagtccgccgtttcgtttacagggctttcaccttctatggcgcagctttccagctgacttcgactacgtcgaactttggtaactccaatgtccagtcctacaaccccgagaagcaagcttctcggtttgggctcttcccacttcgctcgccgctactatgggaatcgagttttctttctcttcctgcgggtactgagatgtttcagttccccgcgtctgccgccaacaagctatgtattcacttgcaggcaatacactgatgtgtactgggttccccccattcggaaatctccggatcaaagcttacttatagctccccgaagcatatcggtattagttccgtccttcatcggctcctagtgccaaggcatccaccgtgcgccctttgtaacttaacctgtactgacttgcgtcagcggttatgcgatgcgaatttctattattagaaactcatacaaatacgctgtgttctcggcaatttaaaacatttacaacaatgatatccagttttcaaagaacaaagaatcgccaactaacgtcaacgatcggcctgacggccaatggaggataacgggatcgaaccgatgacctcctgcttgcaaagcaggcgctctcccagctgagctaatcccccataagggttgttcaattaacaagcgaacgcttgatgggcctagatggacttgaaccatcgacctcacgcttatcaagcgtgcgctctaaccaactgagctataggcccgataggcgtgtagaaagggtaatcccctcaaaactaaacaaagtttcgtgtgtgcaggtttccgtcagactttcagtctgtttccttagaaaggaggtgatccagccgcaggttctcctacggctaccttgttacgacttcaccctaatcatttgtcccaccttagacggctcgctccctaaaagggttacgccaccggcttcgggtgttacaaactctcatggtgtgacgggcggtgtgtacaaggcccgggaacgtattcaccgcggcgtgctgatccgcgattactagcgattccgacttcgtgtaggcgagttgcagcctacagtccgaactgagaatggctttaagagattagcttgacctcgcggtctcgcaactcgttgtaccatccattgtagcacgtgtgtagcccaggtcataaggggcatgatgatttgacgtcatccccaccttcctccggtttgtcaccggcagtcttactagagtgcccaactaaatgctggcaactagtcataagggttgcgctcgttgcgggacttaacccaacatctcacgacacgagctgacgacaaccatgcaccacctgtcattttgcccccgaaggggaaacctgatctctcaggtgatcaaaagatgtcaagacctggtaaggttcttcgcgttgcttcgaattaaaccacatgctccaccgcttgtgcgggcccccgtcaattcctttgagtttcaaccttgcggtcgtactccccaggcggaatgcttaatgcgttagctgcggcactgaagggcggaaaccctccaacacctagcattcatcgtttacggcatggactaccagggtatctaatcctgttcgctacccatgctttcgagcctcagcgtcagttacagaccagacagccgccttcgccactggtgttcttccatatatctacgcatttcaccgctacacatggagttccactgtcctcttctgcactcaagtttcccagtttccgatgcacttcctcggttaagccgagggctttcacatcagacttaaaaaaccgcctgcgctcgctttacgcccaataaatccggataacgcttgccacctacgtattaccgcggctgctggcacgtagttagccgtggctttctggttggataccgtcacgccgacaacagttactctgccgaccattcttctccaacaacagagttttacgacccgaaagccttcttcactcacgcggcgttgctccatcagacttgcgtccattgtggaagattccctactgctgcctcccgtaggagtttgggccgtgtctcagtcccaatgtggccgatcaacctctcagttcggctacgtatcattgccttggtgagccgttacctcaccaactagctaatacgccgcgggtccatccaaaagcgatagcttacgccatctttcagccaagaaccatgcggttcttggatttatgcggtattagcatctgtttccaaatgttatcccccacttaagggcaggttacccacgtgttactcacccgtccgccactcgttcaaaattaaatcaagatgcaagcacctttcaataatcagaactcgttcgacttgcatgtattaggcacgccgccagcgttcatcctgagccaggatcaaactctcatataaatatgagttgttcgaatagctcgatttgttgttctagcgaattgacttcgcaaatgttactttttgcctcgataccgaagtatcaaggaccctgcacatttaaacgaaactttgttcagttttcaaaggactaccttgtcaaaaaacaacttttatagattatcatgatcaccaatgcatgtcaacatcttttttgaataaacatgcagttgatgaatgcgataagcaattaacaatttgacaacgaagaatatgatagcaactttgccaagccgcgtcaacactttttaaatgaggttttaataagaatttctaagccgaacgttcaaagaaaaatgcagcgaattattaataatccgctgcataaagatgcactttttgctattaatcttcctgcttgattgcagtttggccgtgcatgtagggaaccagaacgtcaggaatcttaaccgttccatcagcttgctgataattttcaagaatggcagcgacagtccgtcccactgcaaggcctgaaccgttgagtgtatgaacaaattgcagcttgccatcatcatcgcgataacggatttgtgctcgacgtgcctggaaatccgtgcaattactgcaactcgaaatttcacgatagcgattctgcgccgggaaccacacttcaagatcgttcgttttagcactcgtaaagctggcatcgttgctggccaaggtgatgacgtgatatggaaggcccaacttgcgtaacaagtcctctgcatcgtgaatcaaattctttaattcttgccaggaatcttcgggtttgcaaaacttgaccatttcgaccttgttaaattgatgcatccggattaatccacgagtatcccgaccagcgcttcctgcttcggaacgaaaggcaggtgttagtgcggtgaagttaactggcaatttagcagcatcgataatatccccgcgataataattgaccagcggcacttctgcggttggaatcatggttaatggctcaccatcgtttgtgatggtgtacgttgcatcagtaaacttaggaaattgacctgtgccaaacattgaatcattgttaaccaaatatggcggaataatttcttcataaccttctttttggtgttcatccaagaagaagttataaacggctcgctctagtcgcgcacctgcacctttatagtagacaaagcggctgcctgatactttggccgcccgttcaaagtccaaaatacctagtttctcgccgatatcccaatgatgtttcggttgaaaatcaaaatgaggaatgttgccccatttatattcttcacgcgagtcgtcttcatttagtgacatcgggacatcatcggccggaaagttaggtaaccgaaccagaatataggtgactttctcattcagttctgctaattctttatctaactggctgattttttgaccaacttcacgcatagccgtgatttgctcgtcagcgttttctttgttccgtttcatcaccgcgatctggccggaaacttcattacgctttgcctttaactcctcggtttgaactgttaccttacgtcgtttctcatcaagggcgattaattcatcgatttcttcacccttgatcgtgcgagcagctaacttcttttttgcccactccggcttttgccgaatcaacttgagatctaacatattatcctccttcaaaagtatcaagcagttcacaaaaggccgactttcctggtgcttgccatcgctagggtgcgcctctttggccaactttggactgctgtacttatttctaatcgaaaacccgtctgagtgctcagtgcacacaaaaagcccttcatctctaatgggacgaaaggctttttccgcggtaccacccaagtttggcgcataacgccaccctcttgaggctgataacggttgtcaccgtgcagttcatcactgcccactaaggcgctggaatgaggatgatatgtcagcttgcaccacccgctaactctctaaaacatccattaggcgcttcagacgtgtttactatacgttgttagattaccgcatctttcgtgtttagacaagcatcgagagcagttttcactaaaagaattagcaaaacgatgcgtcattttcaatagataaatcgcgcatctttgagggttttcccgtcccatagttcccgcaaaaggctataaagatgcccataatgatcgttcgtgacattgatgtgccatgggaagatctgggtttgtcctgctgcatccttaatggcaccaaccgaagtcgtaataatcaggtcaacatctttaaggtcggcatccggtgaagccaactcaacaaatggcaccgcatgtaaaaaggccaataaatcaatgtatcccgtcaccgtttgttcaatgaccggcgcaaccaatactttttgttggggctgaaattgaaccagtagttgatgcagattgcgataaaacgcttctgccaaaacatcgcggcagccgacaaatgatgtcagttgctgactatcaatcacctcatcaagggttactttaacctgctgataaaagtccgggtcatctttggtttgctgcatattggcactaaactccgccaacaagctggtcgtgaagtctttgttgaacgctaacacgctgacggtcacgcttagcatattggcaaataacaaattataagtatcatccggcaaatggatatcaagcttaaagttatacggaaaacgcgtaaagaaaccgttaataagttgatagatttccggattatagtcattgtaacgggcaatgattcgttgttctacctggccatccgtaataatatacagcggggcaaaattaaaaaggaaatacaaggcatcactttcactttgctgctgctgcgttgtcaggtgctgcaaccgcttcgacttatccagtaggctcaaagcagcatcactaaagagattcgggacaggatattgcaaaactcttgagccggcttcatgtgacaaaacatggccgcttaaaatacgctggtgagccaccgcaatataatacatcaacaattctcgcgtaatcttgttgaccttgccactgtcaaacacaaccaacaagtcatctaaaattttgcctgcacgatcatgggataagttttcaaatggccaagcgacaccattcgttgccaaccagtaagcaatggtgatgaacaatctgacattcaattccgctcccacgaaggaaagtgtctcgtaagaaaattggacgccactttgccgggcgtaaccgcgaatgactttcaaatgtcttaacacggtcgctttagaactgtcacaggctcttaaaaagtcatcaaagtcttcatatcgctgatacaaaaccgcatccaaaaaatgatacggatttgactgtttaaccaaaaaatagcgaaactcatcaaccggtattcccagcaatgttttgaccgacgcatgttcgcggccaatcattgcttccagcgaatgcatcaggccattatacgtgttatagacgctgccataattacgattggtaattgccgcaacttgtttaaggttgacttcactaaccaatggccggtgatcccgatacgctttcacccgctttttaaccggtgtctgggcttccctgacgtcaataatggtccgaaacaaactcagcttttcagcatcggacattgataagaaaatgtcatgattgtctttcataaaatctccttcctgtagacttctgtgttgggtaatccattcatttggaaacgcgtggcataaagacttgaagtagcagcccacgagtcaaggtcattctctcgtcttcttagaccagcacgcttgatactacgcctgtatgtctgaatcaggcgtcaatttaataggaatttctagatatcttgattatacttcactgaagacgcataatcagcttcttacccctgtctggcctattgctataccaacttgtgaatctgcccgttatttgattcacttacttaaggttacaaaagctcaatcattcacgagagtcgcatcgcttttgtcattctttggtataattagaggtgaaggggttttaattgctacagattggagggtacgcgatgctttatgagcaaacttttcttgaccgcgctgacttgcagaagtttcaaatgttttcggctatcaaggacagcaccgtccagacctataccatcaataccctcagtcgccacctagacctttcatatcagcaaggctataacattttacaggaactgtttcgggatatggctggtttgacggtccatccggaaaagttaaagcgccgtcaaattaatcttttaatggaaattgatgtcactgtcgacgattatcatctttacctgctgaaacatgccattgcttttcagtttgtggactatatcgtgcaagccaatcacccatcaaccgaaaagttttgccaagcccattttatcagccgctcgactttggtccgtaaaaccgccaccttacgcaaattactcaaacgatttcaactaaaactttcttttagcgatttaggctttattggccaggagagccgcatccggcttttcctgtttgacttttattggcttggctatcatggcgtcgattggccgtttaaggttctggatgaacatcagattgtgcaggaatacatggccttgccgaacgccaaaacgaatccggttgatattcttgaagaaatccttttttgggcgatctgccgcgtccgtatcagcggcaatcattttgtcaccggtaatgaagcatttgatcggatctttaacgactatccgccttttcaacacgatgtttatacacgtgagatgttccctggtttcaaccaacgctacatgaagggtgaaaatgactttttttattttcagcaacatcggaccatcaccttcttgccaagtattccggacgatcaaaacttcatccaatatttattgcagcgaccaactgtcacggcagattttgtgaaacgcttattggctttcttaaatcagcatgtccggcatcaaaccgcttttgatctcaacaatgaacatgggctcatcctcaacctcgcacgtatcgctttaaataatgagatgctcggtggggacttcatgcatttggttgacttctatcagccgcgcggattgaattacacgaagacgaatctattccgggtcttggagaaattcgtggcatccttgccgaaaactcctgaatatcagtattttttgggaaccgaccatcaattcctgcacacactttatttcctattaacgccttatttacgctactttgttgaaacgccaactgtacaggttaaattggcttacctggatcacgacttgttaaaccggcgcatggtcaatctgttgactgatttaccggttgttgatttacttccagaagatgcagcatttgaaaaagctgatcttgtcatcaccagtgtggacaatgaaccggctatcaaggcagctgttccggccgattttcgcggtgaaatcattagttggatgactgaagatagtgacaatgctattttccagctctacttgcagattcggcatttatatcttaagaaaaccgatgcttccttatcggctgacaacgatgagcggttataaatcgtcaccgcatgataaccagtgacaatttcaaattggtagccttttgcgaccaataagagtgcgtaataaaaaacgacctgaaagatgacattcatccttcaagtcgtttttcatttgtaagcttgttatttaggattaggttcatgttcgcgatgcggagctaggtcgactttttcaagcgggatcagtttggttttatacttcactttataccagacaaacagcacaataaaaagcggaattgacatgtacgacaccattaaccgtccccaagcaaagtgctggactgcttgcaaatcctggcccacgatgacgatcagactcatgataatcgccatgatcgggccaaccgggaaccacttggcatggtatttgagttcgtgaacatcatgtccctgtttcacgaaagcccgccgaaaccgaaaatgcgaaaccgcgatcccgagccaggccaggaacccggttaaccctgacgccgctacaagcagctggtaaacgtgtggtcccataatactggtcaagaaagttaatgcgccaaccagagttgttagcaacaacgcagcaagcgggatgccgcggctgttcgttttttgaaaaatccgcggtgcaaagccggagccgcccatcgcccacaacattcgcgtcgatgcatacatccctgagttagccgatgacaaaaccgaggtcaaaatcacggcattcatgacacttgctgctcctgcaagtccaatgcggtcaaataccaatgtgaagggcgaaatcgccacctgatccacgctggctcccaacagattcgggctagtgtacggaataatggcggcaatcacggcaatcgacaggatataaaacagcaaaatacgccagaaaacctgcttaatcgccttaggaatacttgtttcaggcgtttcgctttcgccggccgtaatcccgatcaactcggttccctgaaaagaaaaacccgcgacaacaaaaacagccaacgttgcggggataccacccacaaacggcgccgcaccggttgtgtaatttttgaaaccaatgggaccatgcccacccatgatccccataattgtcagtaacccgacaattaaaaagacaaacaccgttacaaccttaatcaacgacaaccaatattcagtttcaccaaatgacttgaccgaaataatgttaatcaagaagatcagcgccaaaaaccccaacgaaaacagccagccgggtacatttggcagccaaaaatgcataacaatggcagtcgtcgaaacatcaaccgcaacggtaatggcccagttaaaccaatagttccaccctaaagcaaatccgaacgccggatcgacaaaccgactcgcatactcggaaaaagagccggaaaccggtacatacgtggccatttcacctaaactagtcataagaaagaaaaccatgagtccgattccgatataggctgcaatggctccacccggtccggcagtggcaatggcgctgccacttgcaacaaaaaggccggttccgatactaccgccaagagcaatcatggatagatgccgtgtcttgagctctcgttttacttgattggatgctgattgtgccacagatgaactcctttgttaacgtgaattgatttttgctaaacaatgccagattttactgacgatatctggaatgagattttcgtgattggctggttgttgacagccggtggcaggttaggtgcaacgatgcgttagccaaagaccggtgtttatggatggaagactgcagcaagggcagaagcattcttctttgggcaatccgttaattttattctgctttctataacgcgttcgccagcgcagggatctgcgtgtaaggacctcgaacgcgatggcccaagaccggtgtttatggacgaaaaactgcaacaaaggcagaagcattcttcttcgggcaatccgataattttattctgctttctataacgcgttcgcagtcgcagcaatctccgtgtaaggacggacctcaagcttaaatggccaaagcccagccatttaagcttgaggccacttacactccgattgctaagcgctcctgctcacgctcacacaaaaaaagccaatgagtcggtctgttgtgactaacccatcggcttattctgctttttaccatgaataaacgtgatccgatttgttagcgccccgcgataatcgcgacagtccagtggatattatccaactggcccaatatcgattggctgaactcaaccggtatttcggcacctttccctttaacaactgcgcgcttggtgttcagaccattgcagctgcgactcatgattgatgcgacctctaatctcaattacgactcaccatatcatgttcaactaacaacagcaactcactctcacacggctttaactcaactctcagctttaagaatatcagcaaccaaacttgttgtatcaaattgttgcttcaagaaaggctgatcatctgttggcaaatgcaactggaagtcgctaaacttttgtaaaaacagttcgccactatccaattcgaagccaagaatatgcccacccatactatgatcagcagccagaaaatggacatggaaaccaggtgaaaccgcacccgcatagagatccggtgaaaagtacccaattaaagtgcccttgatattctcggcatgaaattctttttgacccgaggccgtttcggtcaaggtcggataagatggctgttgcggcagcaccgctcgtgtatgcatttgcgtaaacgtaccttctacacgaaccgccgcaaataaattactggtctgcagccgctcgagagtcgctttgtgaaacccggccaaatcaagcccctgaagcttaccagctgcaacgtcgtgttgatagtgaacgttagcaaaaggaaccttctcgtcttcttgcacttctcgaactttaccttgggcattcacttgataaaccttacccgcctgaataattaactcaccatcaagcccagtcaaagttccaatgccagtatcaccgtgctgcaacaattccccaactgtctgcgtccccgcaaaaagccccggaaccagcatggctattgttccatgttgatacaaccgatccgtattcaaaacgacatctcctttttgaagtgagcgtgaaccggcgcggttaggggtcggagtgtaaacagacaatctcacactgagccccacgctccccacgtcagtccagttaacgattaatagatctgatcaggcaacatcgcagcgccaagttcggcgttatcggaatagtcaaccggaatgtcaacgatcactggaccttgagtcgcaaacgcctcatcaagcacggttccaagttcgcttggcttatcaacacgcaaacctttggcgccaaaagcttctgcatacttcacaaaatcaaccggtccaaagtcaacacctgctgcacgcccgtatttcatctcttcttggaattttaccatatcataatggccatcattccaaataatatgaactaaatccgccttgagccgcacggcagtttccaactcttgacccgagaaaagaaaaccgccatcaccggatattgaaaccgccttttttcctggacgaaccaacgttgccgcgatcgcccacggtagtgccacacccaatgtttgcataccattcgagaaaagtaagtgtcgtggctcataactacggaaatgccgtgccatccagatgtaatgactaccaacatcaactgccacagtcatatcatctgcgacccgctcctgtaatgcggcaacaatgcttagcggatgaatcagcttttgatccgtcaaggctggcggtacgtcgctgtcttgtaatttagattgtaattcactcagataatgtttactctccggggccacctgataaccgcgcagcaacggaaccaaaatatccagtgtttgtgaaatgtcaccaatcaattcggtttccggttggaagttgtgatcaatttcagcaggaacatcatcaatcacaatgatgcgggccttgccatcagcattccagttacgaggttcgtattccacaggatcatatccaattgcaataaccagatcgctatgttgcaacaacatgtcacccggctgattacggaacaaaccgacccggccaaagaaattatcgatttggcgatgcgaaataatgccggcaccctggaatgtttcgacaaccggtaactcggtgaccgacaacaactcgcgaatttcagcagtcacatcgctggacgatgcacgcatacccaacagcaacactggtaatgaggcttccttaatcgcacgtgccaagtaagtcatgtcactagggctggccggtcccaactttggtgccactaacggtttgatcggttcggaattgaccggtgaatcggtcacatcttggggaatcgacacaaaacttgcgccctgcttgcctgattctgccgcctgataagcgttggcaataatttcactaacattgtccggatcctgaacttcagccgcatattttgtgatcggcgcaaaaagatccgcattccgcatactttgatgggagctacgtaacaaatctgctcgcttaacctgtccggacaatgccaaaaccggatcgccttcagcagttgctgtaacaaggccagttgccaagttcgaagcgccaggtcctgaagtcgtcaagacaacgccgggcttaccagtcaaacggccaatgccggctgccataaaggctgcattttgctcgtgtcgggcgacaattaattgcggactttttttagttttgggatgttctagggtttcaaaaacccgatcgattttggcgccgggaattccaaaaacataatcaatcccgtgatttgctagactctcgacaattaaatctgcgccataacgcttctcttcagccatttcgccacttcctcattattgatgtgtttcataatacgctttttgtgttccgtttcaacccctaatttaactgaaaaacaccgattaaacagagcggttctgttacagtattttcataaatctgttacattcttggcaaacttgtttaaaagcctagtttaatctttccaatataagtttaactgatttagtaggaacatcgttaaaggaagctcacgccaaactaaaatcgaccgcaagacaacttgtctttgcggtcgattttacttagttcctatactgtttcaagatactgcggcatcattttaccggctaccggtctattgtaaggaacgactgattttaccgataccggttttcggatcagtcagtttcaggttaaatccaaattttgtgaaaatatgccgtaacttggctaaattaactttatcaaacgagctaatcgtgccatccacgagcgcaacgtcggccttcatcgccaaattcagaaaagctttcagcgccaactgtgcgaggccaagattctcaaaatcgtaaaaagccaagcgactttcggaacccagcgtctctaaaaccgtaatatgcatcacgttgtcccagcgattcgtttcaaataagagctgtgcctgataatctgctttcgaatggccatatttgtcaacattttcaaacggtgtgtagacgtaaatcgagttggttttttgtttctgttcatcggctttaaaatcggtgaagacaatatattggcgcacgtcattttgatccgattcttgcggttgattcatgcttgatagcactgtcaattgcggatcagcttcgattgctgcaagccgcttatgataggcctgttcatactctgtttgcacagtcattttgaaacctccagactaatactcgttttcattatagcatttttcaattcgttgcctatataaaagagaaaagccggattgaattcacccggttttcaaaaaaatattaaagtaaatcctcattttcaaactgattcggtaacaatctaaaatattgttcatcgcggggatggtcgccactcaatccccgtggcagcggcacttcgaattgaaatgtaaagcctaaacgtttcaacaagtgaattgaagcatgattactaggaaaaacacctgcccaaatagccttaatatcatgggcgaattgatttgcaatgaccatttgcagtccctcacgcatcaaacctcgatgccaataagccggatgaaggatgtagccaatttcacgcgtcatatcatcccctgtcagtggcgataactcacgcggataaaccccaatgttgccaatcacatgcaactgataaacaagagccagatcctgacgctcacgagcaaaccgcttaacgtgattcgctgcttcttgacgagtcttcaaaggcgccatccctgccgcccgcgtgacttgttctagtttggcataagcaaaataatcatcaatatctgatgtcgtaaaaggacgaactgtcactcgcggacctttcaaaatgacgcctcctaaaaaaagtgagcgcgaaccggcgcggttagaagtcggagtgtaagcggccttaagcgtgatggccgggtcttggccattgcgcttaaggtccttacacgcagatccctgcgccagtgagcgcgttatgggcataagctagaacacaggcagcctcagacgcgatgcccctgtcgtgaccattgcgtctgaaatcctcacacgcagatcccagcgctagcgaacgcgttacgaaccaacactcttataatcaaacggccaagacatccaacattcactcataacccctaaatccacacatataaattgcggcctgtgaaaatacgttaaccttgtctcatcaactgacaaaatttttccattttttgagacaaaaatatttccagtagcaaattttctcgcgattgcggcgcgcgaaactatttatcttttcatattatcaagtatcttccacggtatgacaagcctcagctaattggacatcgaacttagcctaagcatttgacgactgattatttgttcttatcggtaaaataaagtcgttcaaacaactccttgagaaaggtgcgtgacaccatgccggcaagcactactgttagtcgaaagttcgccaacttgcaggaacacattgatctcgcggcgaggtcacctgccatcacctcacaaacatatatggtgatttttccaacatactgaggacttttaagtaacaaccgatctactagccaaagttaaccacgtctgataatcagtaatggcagctgattccgttctcaacgaacagctgccctacataccgacaggcgaaaggtgacgacaattgtgaaaaagataataagtcccattttggttcttttatttagcgtgctctttatttggccattgaccgtgacaaccgctgccatttcaccaacattcacggttacgccggtcctgcctaataatcagcgtcagtcggttaccggttactttgacttacaagttagcccgggccaacaagaagatttacagctccggatcgctaatcaaagtgaccagactcaaacctaccgtattgcagtcaatccggcatatacgaccaatagcggggtcattgcctttgatcaaagccaaccaccgcttgatcaaaacgccattcgtctgagcaccttaattcaaggaccaagaacggttactgttgcagccaattccgagcaaaccgtaacgtatcagttgcaagctccagctgagcattttatcgggattatcgcaggcggcttttatgtcctgcaagaaggcgccacatcaagtcgtgcttccagcaacggggttcaattcacaaaccgctttgcaatcggcattacgaccattttgcggcaagatcttaccacgccgaatccgccattgcttgatataaccaaagccagcatcggcaccaacaaccacacaccggtcgtcaaggcgcggctgcataacccttcaagtaatcaattcggtgaaattgcaacagattatattttggttaaacccggtagccaaaagccgctactgacaggtcattttacggggttagcggttgcaccgcattccttttttacccaaagtatgcctttgaatgagaccaagttggctgcaggtacctacacgctcaaatggacggcaaaatcgggatcttacacttggtccaaacaagtcaactttcgctacaacggccagttaccgatcagtgtaactgcttcccgaccacgatcaccaagcgatgcggatgatcatggcctgcttccttggataattgccggcatcatgtccgctttgctaatcattgttctcggtctatggcgctggaacgtggtacaccatcggcaaaatcagtagaaaagcgtgccagcattgacagtttgacttatgataaaggtagcgcgaaaccaaatgattatgaaacgccttggaaatgtaaatccttctcacggtgtcatctgtttggtgcgcattttgatcgtacggtcatggctggaaataggcgttgcgtatgctaaagtgctgccgagtttaaagctttgcaaggctagatcgtttgtgggcatcggtcagcatgaaggatcacttgcctgcattcatcacaacacgtttgccagccgcgaaacctgcgtgtaaggaggagttttgatgtcgaataaacgtgtacttggcaatgagtttcaaactgcctatgaaaatgccggtggaactgatattttgaaatttttagcagatgttaagcaggcttatcgttgcattagcgacttaaccgctcgaatgacagcgatgcctgactctgttaaaagtgagtcggttccgcaactattagtccaacaattagatcagaccacctttgctgaaagttcggttcgtaaatgggaagatgatttacggcgttttgctgcttatctgacaccgctagaacctccgattgcaattcttgacagttgggataccctgaatgatttcttggaagctaaccaagcattactgagttcactgcaaaacgtgccattgctacatgaagacacacaagatgttaaaacttcaacgcaacttctcgtttatccggctgagcccctctttcaagtcgttcaggccgatactggcgaaagtgatgccattgacctgcctggcttaaccacggccgatcctgatggcgttgcggaaattgcacgaacccacggcgtcacgccctttgctgcctttaacgcccagccttgattttagtctgtcaatcctgtatgcttgacaggttaaattagaaaaaagcgaggtgctaaaagatgcggaacaacatcatcttaggtaacaatgaaaccggcgaacgtatctatttaacttccaaaaacaagcgtaacacgcctgatcgtttgcaactcaagaagtattcaccaaagttgcgtaaacgcgtggtcttcaccgaagttaaataatctgatcgcagttcatcagccaatatcgcattctgtcagttttttactgatagaacgcgatatttttttgcttttgtgcctgattggtgagaatgcccatactgaaagctattgcccaacgccaaataagccctaacctaaaagcagcggttgtagggcttggcttaaataaatggccaacagtttcggatcggcaacgatttcaaccaattaactaatagcaagctacttcaaaggtaatatttggtctaatatggccttgctaaggacatgttgaagcggatttttgctgacacttgtgatgagaccgtcagcttccaactgattaatcatgcgttttgtccgcgacctaggagtttgttttgaaccctttttaagcacttggacaatatcacgatcctgaatgccataagtgatgctctccgtaaacaaataagattggagaagcaagtataagatatccttcatctcgtcgttcaggtttgcaaattttgaatataatttttccccggttacatgtagttgttctttagctgactctaattcttgaataacttcaagttgaccgtgttcaataatttttaacattccttctaagaaaaaagttaactccgcgcgattttcaatattgtctgcttcctgaaaaagccggtaataagcagaaagattgttatgaatcgctgttgatacagacaagccagtgaagggatctaacttgcttgacaaatatgacgagagcaaatacctgccagttcgaccgtttccatctaagaacggatgggcattttcgaacataaaatgggtgatgatcgctttttccaatgtcactaggtcatcattattcataaagatgatgagctgttctaaagccgtctcaatctctgcttcatcaatcggaggaatatggaccgcatgtgaaccagtcccaataaatgcaaatgagtttctgaatcgtttaccatccggcaacttttctggtggaatctccccttttaacaactcatcataaatatcacgataatccttcaaagtgtcaatctgacgcattcttgcggtaatcgagtcatgatacttgcgaatggttgattccaaacgtttttcaactctacccggccggttttttaaattaccaataatcgtcccgatctctttcgggtttgtttcaacaccttcaatctcattggtaaaaataatctcattgctaagaagcttctttaaataactgttaatcgcaacttgaggcaattcattgtgatttgccaatttggtaatctgcattgagttcctaagaatattagcaaccagaagattaatcttgtgagtttcgacaaaataaatcggatacttggcgattgaaatagagcgcttttcgatggctgcttcatccagaagactcgtgttttcgagtgccggaaagagcgcagtccggactgttgagggacctgaaagccttaaatgatattcgtcatcaatttcctgtggtgattttctgccagtgccattgttattgtatttaaatctgcttaaaggtaaatagctcacgtttgcgcctccattctttaaaatggcgattattgaaatctgcttttcaaattatgcatatcgattttaaaaaatcaagcatttttaaaaattgactcccgcatttttaaacactatatcatacaattgtcgaaaatagactattaaaaaaccttctacccgcatcagcaaataaaaggcgtgttgcgtttatgacaatcaggatctggcgctactgatttaaaaggttcacaaagtcatcaggaatcggtaaatcagcctgaattcttttttcagaaaatgggtccacaaaacttaaatgggtcgcttgtaatgcctgatgatcaatgagcggactcgcttggccataaagtgaatcaccgattaagggatggccaaggctggcaaagtgtactcgaatctggtgggtacggccggttaataattgcacatcgaccaaggtgttgaccgcttctttcagcacttgatacttcgtgatggccgattgtccgttttccgtaaccatccgatgaatgccgtccggacccagaccgatgggtgcttcaattgtcccggttgcatgactgaggtgcccggcaaccacggccagatattcttttttcaaggttgcatgatgagcctggtcaaaccgcccttgtgcatacgggtgtttcgcggctaaaaccaatccaactgtatcgcgatccaggcgcgtgataatcgcgggttgcggttcggttatcttttgctgctgcaggtaccagacgatgcgattcaacaaactgtgatgaggatcatgaggaccgggaacgctggttaaatgagccggtttattgataatcagccagttttgatcttcatacagaacatcgagcgaggctttttccggtgtcaccgtcatcgtcgttggaatggcgaagcgcaccgtctgcccagcctgaatcgctgtattgccagtgcgatgaccatccagccacaataaatggttcgctaacattttcttgaataatctgtggctaacaccttgtttggctaaccagcgcttaattgtggttgccgttgtcacctttgaatcaaacgtatatcgcatgcttttcctttcgccatcccaataatctgatgtttcaaaaccgaacaaaaatatgtaaagatttgcatttaaacggcttttgggactatggttagaatatgattaatgtataagaataaggaggaataggcaaatatgcaagtggaaaaagacgtgatctatgatgaggcccatgatttacccgttgatatttacgtaccggacgcggctaatggcggtgccgtcatatacgcacacggtggcggctggttccgtggcgataaagaaaacgaaagcgatttgggccaatatcttgcggacgccggctatctggtggctattcccaattttcggctagctcccaagtttctatatccgaccgcccaaaacgactttgatcatttcataaactggctacttgcctctccttatgaatttgatcgcgaacgagtaggtttgttaggcgccagctcgggaggcacaatggtgttgcaaaatagtctgaccactggctacccagttgtggcatggtcgcccgtagttgattttgccaactgggtgcagaagaatcaaatggtaaaagcctcggttgacgcgaagaatgaactgggcctgaccgaaattcatgaaatccatgacgctttttataaatactttattcagacatatctgggcgggttggatccgcgcttactaaccgccgttaacccaaccaatcatttaactgatcaactcgggccaaccttattgttcaactcggcagatgaattaatgccattaccaagtgccctgcattttgtccagcaagctgccatgtttggccgggacatttccatccacgtggtacccggcgttggccatgcacgtgattataccagttttgccttacctgaaacaaaacgcttcttcgatcaccatctttttgcaagtgttgaagacaaggcgctgaataaagcaaccgattagtcttgacgtcatttcaaaagcaccgcgaatgccagtaaaagttggctttcgcggcgccttttttgatcgctccaaaagataagtctatgtggtatgcgcattacttacggccgaagaattaatggtgtggtggtgccgggtgcaacccattcaatgccgcctgttactggtactaagtaaatcgcgtctgcttcgatatcggttggtgtaagaacataaccattaccgtttgatgtcgccgtgtagcgagacgtctttgaaatgccattttgggaaatggtcatctgagtagccgtaatggtcaatgatacatgttcgttatgccacgtaccaacataaaacggcgcttgaaccgtgggctgacttgccgtttgggtcgttgctgttgctgcagcatcactggttgtggcagcagcatcagtcgctgtgcttgctgaacttgccgtcgtcttttcggttgtcgttgcaggggtcttaacggttacggtagcgccggactcatgcgtgctggtcgtttgagctgtacttgatgatgagcttgacgatgcctgtgacttgctcgttgctttcggctgacttgttgttttttccgtgactgtttttaccgttgtggttttcacatcgcttttagcactgacatgttgttgatataaagcggcaccggaaacgccgctaagtgctaagaatgccgttgcaatcatcatccattttttcatgtcaatcactcccactcagaagttgtcgcttgtcggatcgtttcaacaatttcagactaacatgcggcaagcggaaatgttacaaaatgatttcaaatcaagaaaatcttaagacttatcaagatttttgctgtcatcgttttgtaacattcaaataaacataacctttttcttgaaatagcaaacatatgttcgtaaactaatctttggggtgagattgatgacttacgaagaaaaaatcggtaagcaaaagtttgctgccttggtggctgatttttttactaatcgttacattgatcgcgggatacgcaagtggcaaggctattacctctccgaccacaccgccgcgttaaaaaaacaggcgcagaccgagcatctgacttatccgccgctttcgttacaagatcaggcttacattcggatgatcttgcttcgagcatacgctgaaggccaatccgtaaccattcagctcgatctgcaaacaccagatggccagatgctgccgccgatcaccggtaaagtcggcggtgtaaccgatagtgatgtcgttcatgtcggcgaccagaacatcagtatccgcatgattcgccacatcgatctgattccgtttcctgtttaatcaaccagagcgtgtgcagtaaaaaaagaccgtgcttatctttcaacacagtcttttttcatctaaaggaagcttcaactagtctggttgggaatcagttgttgccaagtctgccagtgcatcaaaaaagtaagctagactcagataatcggccgtaccacccggactaagattaaacgtgatcatctcagcatttaactgacgcaaggcatgaggcaagtgtgaatccgggacatgcaacaatgttttagccgcatcttgcacgaatcgtaatccctttggcccgccgcgatggaggacattggcatcttcaacttgggccatcaagtgcaccattaatcgtaaatagcgcatatccccgcgtctggctgtcttgcgtaaatatggcaagatcacatgccggatagtcggataaccagccaaagcctcacctcgaaccccagtaacgccgtgtttgacatataacgcttcgccatggctccagcgggcttttttctccaagtcccgaaaatcaccagccacaccttgcgtcacttgagccaccgtcgggaatagcggcgcaaagtcagcggtgactatttgttgcagggattgctgctgcatgagccagcccaatgcacccaataaaaaaccaaaggagaagttagccccacgatgcgtattaacaccagcagtagcggcgagcatggcattttctgctgcaatcccaatggtgcgtaattggcgatagagatcaggaaccgttttagcaacgacgccggcatgaaaatattgctgaaaaaaaggcgtcaaagcttcaatgctagctgcaaaggtcgtcacatccatatcccggtgtgcaccatttgattcagggtcgaccaagccgggtttaggcgccaactgaacttctgcttgtaaactggtaactgccgcttgtgcaattgcttgttcattcaatatgttttgccttcataactttcagaatatagtgcagggaatgctctaagtgctcgcgcgtaatgagcttaatttgatcgtcatcttgattcaacatcccccgataaagcagccaatgttcctgaatggcaagattgcgccgatcatcgccattaatactgatgtcacgaaaataaatcaaataattctgcagctggttgacgatcattttcagccgcaacatatgactggcatcataaataaaattattaaattcagtaaacttagccatcacctcggcaacacgaccggctgcgttcaaacgatccgtttcttccaaaagagtccgcatctgattgaattgctcaggggtcatcagacgcatggccttacgcgtggccaacacatccaattccttgcgaatgtcaaaaatttcataggcatcgttaattgaaatacctttgacaagtacaccaacacccgttttgcgttcaaccagatcttcttcatccaaacgctcaagtgcatagcgaattggcgttctgctgatatttagattttcggaaagattcttctcgttaatccgctcaccgctgggtatttcgcccaaaaggatcgtcttacgcagcgcttcgtaaatcgcttctttaattggccggttctgtgacaaatccaaatttttcttaaccgctgacaccacttgattcatcgattgtcccccctcacctaacccaatattataccttaacgtgtctcaccacttaaaacatgctggctcacgctcacttaaaaagctgccgacaaatttgtcaacagctcaaattgtgctagcctaccaactcacggccgcgcgttaattgattagggggcgaaaggatcatgtaccttaattatgagtaggatcaaacgtcagcgaaaccttttgaaccggcacatcataaaacggatcttcacgccggcctaaaaagtcttttgcctgatcagggaagagcgcataactcaagacatcttcttctgaatgagcatactcggcaatagctttgcgaaatgccggtagttgcggctcaatcaggtctgccggtcgcgtggtgatgactggtgcgtcaccaataattttctttttcatctcaggagaaatcgggacaggcggctgcccataaagtccgcgaacatagtctttgatttctttagggatcagtttataccgttctccgctcatcacattcatcaaactttgcgtaccaaccatttgcgacaatggggtaaccaacggcggataacccaagtcagcccgaacgcggggcacttcttttaaaacatccccatataaagcctcttgtccctgatctttcaattgcgccaacaggttagaaagcatcccgcctggcacttggtaaatcagtgactttggctcaacatctttaacgcgggggtttagctgcccggcatcccggaatcgatcgcgaatcggcgcaaaatagctggcaatgtcactgacttcagctagtttgacatcagtcgggtagcctaagtcctgcaatgccacgagcattgattcggttgccggctgactggtaccgccagcaaatggggaaaccgccgtatcaataatatcagctcctgcgcgcaccgcctcaagatacgtcatttcagccattcccgcagtcgcatgcgtatggacctctagtggaaccgtaatttcctgcttaatgccgcttacaagatcgaaggctttctgcggggttaaaatgccggccatgtctttaatggcaatggagtcagcgcccatgtctgccatttcttttgccagcctgatgaaatagtcaatcgtatggaaatcactggtggtataactaatcgccagttgtgcgtgcccacccgcctgcttggtagcttccagtgcggttttcaaattacgtgtatcatttaacgcatcaaaaatacgaatgatatcaataccgttttcaactgatttcgtgacaaaatcggctacgacatcatcagcataattcttataaccaagcaagttctggccacgcagcaacatctgcaacttggtgtgcttgactgcttggcgaattttccgcagtcgctcccacgggtcttcgtttaaatagcgtagacaagcatcaaacgtagcgccaccccacatctccaatgcgtggtagccggccgcgtccattttatccaaaataggcaaaatatcacttgatggcatccgggtagcgatcaggctttgctgaccatcacgcaaaactgtttccatgaattggactttttgtttagccatgtgtggtccaaccctcctttatgattgcttcaactgccgcttgaacttcaggcaatccgtgtcgacgtgagcgcgcgcaggctttggcgtctccgccacaaaccaagcaggctcgcggaggtaacttaaaatcggtgcgcgaaacctgatgcagttcttcaccttgcaacgtgaccacatccaagtccagtaagtcacaaaagcgttgttgctgctcaaatccgatcattcggcgctttaaactaaccgggtccatgtgcaccgccaagtaagcttcagggccagttggtaacgattcgatttgcatgccttgcacgtttggttgtaattgatcctgcaaggcttgcatcgcagctgtaaacactgtaacgacgcgttttccggttttgaccggtcccggaatccgcaacgtcacgtgtaatagcgtcgtgtccggatttgcctttaaccagtcatactccttggtcatacgcgcatctttggcggccaacatttgccctaagtcaacttgggggccatccaaaactgacaatttaaacattgtgcaccacatcgattaaggtaccatcacgatattcaatcaaagcaaccaccttgtcgccatactgaatagctgcaggcgtgcccgtgatctgataggccatgttcttgagtgcttcaatcgaaaattgtggcaccttcaaatccttaaacatttcaatcagatctggccgggccgggttaatggccacgcccacttccgtcacaacaacatcaacactggctcctggggtcacaacggtattcacattttcgacaatcgttgggatgcgtccacgaaccagcggcgcaatgaccatgctcattttgcaggcggcacttgtgtcactgtggccaccggatgcgccacggatcacgccatcggaaccggtaatcacattgacgttaaagtccgtgtcgatttccaacgctgacaaaatagcgatatcaagctgattaatgaccgcgcctttgctcaacggtgacgcgtacatgttagcatcaatttcatagtgatcggcattttcaccaagcgagactgcagatgggtgatcgaagtcctgcacgtcgatcactttttcaacgagcccctctttcaacaattcaaccatggagttggtaatcccgcccaaggcaaaacttgctttgatattttgctgcagcatcgcctcacgcaagaagcgggctacggccaacgaagagccgcctgtaccggtttggaaggaaaagccatccttgaaataagcagatttcgtgatcacttcagctgcatattcggcaatctttaattccttagggttcttcgtaaagcgggtggcacctttagcaataccggtcgggtcgccaatcgcatctacttgaaccacatagtcgacatctgtttggggaatactgatcggcgtgttgggatatggcattaggctgtcggtaatggcaaccacttgatcggcatacttggcatcaatcatggcatagcctaaggaaccgcaagtcgctttgcctttggtaccgttaatattaccgtattcatcactacttggtgcgcccaagaacgccacatcgatatgaatatcgccacgagcaatagcgcgagcccgtccgccgtgagaacgaatgacaaccgggttttgcatgattccgcttgaaatagccgcgccaactttatcccgcaaaccggagctggtgatgttggtaaccacaccatttttaatgtgttcaatcagcggttcatgaacattggcaattgaactaggggcgatcgacaggtttttgattcccattttggcaatttcagccagtaccatattcatcacatagtcaccttcgcggaaatgatggtgaaatgaaatggtcattccgtcttttaggccggttgcgacaatggcatcatgaattgacgccactagtttactgtgatcaggcttgacgggtttaatgtggcgcgcatgttcatcataaggttgaatattggcaaactcgccaccgaaaacgccatattgatcggcaaacggctccgggatttcacgattaagcttattcttgaccatcagtctacctccattcctgacgccttagcgagcgcaatcgtgtattgagcacgctctaccactggcttgtcaaccatctgaccattgaccgaaaccacgccggcgcctttagcttctgcttcttttagtccggcaacaatttcccgagccttttgaacctcagccaaagcaggcgcaaacacgctgttgatgaccggaatctgccgcggattaatcacggatttgccatcaaagccgagttgcttaatcagctcggtttcatgacgcagaccttcttcgttgtccacctgcgtgtaaaccgtgtcgattgcagaaatgccggcttcacgggcagcatgcaaaataaagttgcgggcaaatgacaattcggcaccatcagcggaacgatgggtatgctgactggttagatagtcttcggcgccaagtgcaatcccgatcattcgtggggatgcctgggcaatttcccgggcattcaataccccttctgccgattcgatggcggccatcatatgggtcgtgccgtttttgataccgtactttgcttcaactgccgtaatgaccgcatccacgtccatgatgtcctgtgccgtttcggtttttggcagccgaattacattgataccgccaagcaccattgcctcaacatcctgatcgccgcctgcatccaaggcattcacccggacaacggtttcaacactgctgtaatcaaaagttttcaatgcagaatagaccagcattcgcgcggtatctttttcttttaacgaaaccgcatcttcaaggtcaaacatgatggcatctgccccataaatcggcgcatcacgaagcatgcccggattagcgcccggaacaaacatcatggttcttcttaatttatccatgcgttaatctcctcccagtcaaatgtcttgttgtcagcagcgcggtaagccgccgcaatggtgcgtgctttgatcgtacaatccagtgcacctttgtcattggcttcaaccgcaacgttttcgatcgccagttttgcaagtgttgctttgatgaccgcacgaatttgttcgccaaattgcttttcaacactgctttgcaactgaatcgtgataccgtcagcggctggtgcaagcgtgatttgaatatcacttgactccagtgtcccagccgtaccgggatgattaattttcatgggttgatcgctcctttatttctgtataaacctctggataaacgagttgttgcaccgttttccaatcctgttgtgcaatcgccgcccgaacccgcgtggcactgacaacttcgccagcaatctgcaagcgcggaacaacaatcaattcgatggtgtcaccaaaagtggcggctaattggcgattgtaaatagcggtcacgggtgacaatggctcttcaccgacataacgccgggtaatgtctaaaatgggggcaattcgctgtttaaaaagcgccgcatccaattcggcttgagcagtcgcaattgccgcatccgcctgatccttgagaaaataactcggaaacgtggtattcgacaccatgtaatcagcggttggcaacaccacgacattcgcccagcgtgaggcgattttttttacgaggcccaagcgttcggcagcggtgaaaagcgagcgttcggctgacagcacaaagacgtaaaccacggcattgtccctagctgcctgctcaatcagatacgcatgaccgcgggtaaccggattggcgttcatcacaattgccgcaaccggctgtcctgagtgctgatgctgctccaacaatgccgtgtagtcagcaaaattaggataaccacgttcgagcaaaaccaccgtgtctgttgccactaactgcttaaagcctaacgattcaaaaaactttttcgtgcttggcttggtatagacaaaactatgcgtaatcgtctcatcatccagccgatccaacagtgcctgaataatctgtgccaacagattttcgtgctgagcatctggtgacaccgcaacctctttaatgatgttgccagctaatgaaccggttgctaataacgcaccatcttcgaaaataccaactgtaaaatcaacgtgttcatccggcgttaaatcagccgcacgtaaaagcgtttgccaagccgttttttcttgcggattcaggtcaaaccaaatacgttttaacgttgccatcttacttcgccgctttatcggctggcgcaaacttaagcagtaatttggccacaatatagataatgaacaaaacgataaacacgccgcccataccgaccaacatcaattcaccagcctgttcaactgctgtgggatcaaacttcatgatagagacctcctagtaaagtgagtgtgagctggcgcggttagggatcggagtgtaagcggccttggacgtgatggccggggctttggtcattgcgaccaaggtccttacacgcagatccctgcgccagcgaacgcgttatagtgagcgtgaaccagcgcgggtagacttccgcacttacaaaccacatcaagcgccaaagaatgacaacaatagcccaccagcaatcactgagccaatttgaccagaaacattggcaccgactgcatacattaagacaaagttctgcggatcttcgtcagtggccattttctgaatcacgcgactcgacatcggaaaggctgaaataccggccgcaccgatcattggattgattttttcttttcggaaaagattcaacagcttagcaaaaagaacgccgccaaccgaatccatgatgaaagcaaacaaaccaaacgcaataatcatcaatgtttgaatatttaagaactgatctgcctgcaatttaacggaaatggttaagcccaagagaatggagacgatgttgaccaattcattctgcgcggtgttggaaagccgatccaacacgccgcattcccgcaacagattaccaaacatcaagaagccaaccaatggcagtgaaatcggtgcaatgaagccagcgatgacggtgatgataatcggaaacagaattttggttgtcttggatacgccttctgccttatacgtcatccggatgcgacgttcatgcttggttgtgactgctttgatggccatgggttgaataatcggcaccagtgccatgtacgaataagccgccactgtgatagcccccaacagattcggcgccaactggtttgaaacaaaaatggatgtcggaccatcggcagccccgatgatcccaattgaagcagcctctttaatgttgaagccgaagaatactgcaacaaaaacggtagcgaaaataccaaactgtgccgccgctccgaaaagcagcataaacggattttgtaataacgggccaaagtcaatcatggcgccaatcccaatgaaaatcagcaatgggaaaagttcggtgttaatgccggccttgaataaaacatccagcaccccttctgccttggtgcccccaacaacttgagttaaaacgccggttccgggaaaattcaccaaaatggcgcccagtcccatcggaaccaataaggtcggttcatattctttcttgattcccagatacatcaggagtgcaccgatcaacatcatcgcgatttgacctaatgtgatagtggtgattccgtgaatgagcgcttccataagcttcctcctccctaaataatgctaataagaccgtcaccggaattgacactttgatttagcgttgcgataatatcgcccaccgtcccggctttaggcgcgacgatttcgttttccattttcatcgcttctaatatcatcaagggttggttttcggtgactgcatcaccacttttaaccaaaatcttggtaaccgtgcctggcatcggtgccgtgaccacttcaccttctccgcttgccgctgccggcgttgctggggcgggtgttggtgctgccggtgccggcgctggtgtttcagctgcaggtgttggtgccgcagccggtgctggcgtcggagccgcggcagccggtgtcccgccgatttcttccatttcgaccaaataggttttcccatcgatcgttatcttgaactttctcaacatcttcttcagtccacctttttcttaattgacttgaccgcgtactgagcatcgccatcaccagcagcaatcgcactggcaattaaacccacacgcttagcttcgggattttcaacgtacagatgtttcaacaccagctttgcatcaggtgccgaatccgcagtaactgccgcggcaattaggctggcagttaactcggctttaggatcaacctccaaaaagttcggcaccgtttcccattgtgttgtttcgaccggagccgctactttcttcgttgtcggttcaaccggtgtctgcggcggctgctttttacgatgcaaccatccaaacataacatcacctcttctcttaaagtgagcgtgagtcagcgcgcgagacttctgcgctgatgaacgcgttatggtgagcgtgagtcagcccgcttgcgaacgcgcgttattaaatagcgcaacccgcataactttgatagatctatcatacggggaaaagccaatcacaattggcttttcggtgtcttttttcggttaaatgctatttttgcggcaggtagaacggcacgtgaccaaagagcataaccgtcaccacgaaaattgcaaacacgcctaatgcatattttccggcttcgcgttgccacttacccatatccaagccggttagccgcagtaagaggtagatgaaagcaaccaatggcgacagtaagtggaatgcctgacccattaatgaagccaatgccatttgcatgttagtaaacccataggcacggccggcagttgccaaaaccggcataacgccgaagtaaaaaccatcattacttaagaagaatgtccctggcgccgaaatcaatgcgatcacgagcccccagaagccagccatagaatttggaataattgcggtaaagctcttagccaacgcttctgccatcccggttccttggaacagacccatgaagaccccggctgcaaacaccagaataaccacttgaacggcatcgccaccattagcgccgatccgtttgctttggtcgcctaacttaggatagtttgccatcaatgcgatacaggttccgaccaagaacagcaacaatggcggcattgcaatggctttaataaaggaacttgccaccaaccaggcaatcagaacaatcgtcaaaataccgttaaacaggaacatattcgggcggcgaatttcagaaacttccggatccactaccgatgtcatttcgtcaatttcttcatcggttaactcccgaactcccaagcgtttccgttctgcgcgacccatgtgcggtgccacatagaagatcacataagccagtgccaaaatcatccctggcaacaggtaggtcaaaatatccgcatcaacttttaaaactgccattgcccgtgcagttggcccaccccaaggcaataggttcatgatggtattttgcagaataatcaaaacacccaggttcatcatattcatgttgagcttcttataaatcggaataaatgccgagcaacaaatcaaagttgtggtcgtgccgtccccgttgagtgaaacggccatcgcaacaattgcggttgccatcagcactttcattgggtcgccttttgcaatcttgatcatgcgtgccgtaatcggatcaaacaaaccagcgtcaagcataatggagaaataaagaatggcgaataagagcatgatcccggtgttagcagtcgtcgtcagaccttttaacacgaaatcgcctatcgttcctttctttgccacgccagccaccattgcaataatcgcaaataatagcgggatcataaccaaggaagtaaacggtgaaagtttcttagtcatgatgacgtacatgaagacaatgatcatggcataagcaatgacggtgagtaacatagtcccaacctcttttcataagtttttatcgctgccctcatattacgtgatattcgtcactaaatggcggtttttccccgtttagaacacgaaaagaacaatcgtcgtttgaccgcaaaaataaattttttcaaaaagaaagcgcccccattggcttaaaattcgcttttaagtcaatgaggacactttagcaaaggtgtgcagattagtttgaaaagaggctatagctattgttacatagttcacattcaactaatacagaaacaaaattctgtatcagtctaccagtcctggaagcgttcttcttccaactttttcaataactggttgaaattttcgcgcgatggactatgactcagtgtttcttcctgaagctcgttaaaccgctctgctaagtagtaagcggtcagataaagtgttagcttccgtttaacaattgtttccggatctttgtcatcgggtacctggtgtgaaccaacaacaagattagcgaactgtttcggatttaaccgtaaatcatccggcgaatcagccttcatgatataacccccttttcttaagtatgcctaatactaacataaaaaaagaacgcttcttgagaaaaaacgttcattctcggtcaacctgatgtgggcattcgggttaggaactttcgtaaaatttttccagtgagccaaacccgactaccagtggggtaaaaaagtgcgcccgccgtgaatgctgctaatgcgtcaattcgaaaaataaccgggtgcgcatcatggcgcgacccgacttgtttagccatgtcaagatcactagacaaatggacaaaatcacgattcatcggccgcaacccctcactttcaatcatgatggccgcctgatgggaagtcccatgatacaaccaagtaggtggtttgctggcaggcattagcggtaaaaccggaacactatgaccatatactgcccgaatcttattaccttcaagcgcgaatcgccgcttatcgctttgacgcatcatggcagccagtacctgtcgatctaaatgcatctgataatgtgtgttaaaccgttggatcaaggtgttcagatccacgcggccatatgcatcaagttttaagccgagtctttccggatgatggcgtaaaataaaactgagaagcttactgatcttcacaagttgtttgtccattgctacataccccattttcgccaaatccaatgagactaaggaaggatcaccttgaaacttaatttatccactgcacgcatgtccgatcttgatgcaatcatgcaaattgaacatgccggattcaccccgcaagaagcggccagccgtatcagtatggcggcgcgcatcacgaactatcccgatacctttattgtcgcccgggttgcaaataccattgtgggttatgttgtgggtccagccactttcaagcctacaatcacagatgatctttttacggatagtcaacctaatcagcccgctgccccttaccttgcaattctcagcttagccgtggccccaaacatgcaacaccatgggatcggccgccaactactaactaagctgactcaagttgcgcaattgcaaaaacgcactgcgctcactttaacctgcctatcacgtcttatccctttttatgagcatgtcgggtttcataatgacggccttgcagcttccacccatgccggtgaagtctggttcaatatgtcaaaaccagtcaagccccttgcaaaaatctaggttgctaactttggcgtagatgctgtcgcaaaatcggtgctgtttctttgactaaaaaaagcgacccgtcagcctgtgccggcaaactagcacccaaatcgcctaaatcaaacggctcaaaaccaattgcccagattaacgccgccacttgcttcttagcctgaggatcgtcaccggcataaggcagtgcaatgcgatccactgattgattgggacgtgtgagctgtgcaaataccgccatttcaattgaattaaaggctttgacgacgcggtgtgaatgaaaatgctccgcgaccatttgtgacgttgctttttgatgacattcaatctcgggaatccgttcatcccgatctggaaagtaattggttgcatccacaataatcggatcattcccgtttggtaacggtaacgctttgatagcaaaaaacggcaccgccaacacgactaaatcctgcgcctctgcctgctcaactgtacctgttgctgcccccaacacgcgtgccaaatcatctaatgcatccaccgaaccgcgatgagccagcacaacggtattccccgcccgcacaaaaagctgcgtcaaaacctgaccaacatcacctgcaccaatcatcccgattttcattcatcatcacacaccttcattattcattaattatatcgcgccatcgctttttgaggcaaataagcttttatatccttgttatgcgtgcagatattacatcttttataattatttaatttagcagacagactgggccagttgtctcttttccactattatggtttacaaactagtcaagtcggtttaaactactagtatgcaaaacatgctagttgaagggaagcgatgcacgtggcagccgacgcgaacagtcagatgctgaaaggaattttacaagggtgcttgcttattttactggcgcgaaaagaacaatacggttatgccatcagtgaatcgcttgatcttttcggatttggcgatgtccccaaaggcaccatctatccgttattaatgacgatggagaaaaaaggcctgctagtcagccacatgcgcccgtcaccggatggcccgcagcgcaaatactatgccgtgacgcctttgggagaaactgcccgccagacttttatggtgcaatggtcggaacttaaagatcatgtcgaacagcttattgccgatcgaccggagaaataaagcaggttataacgcgacaataccgccagacctagggggacttgacgatgaaaaaacaagatcaggcagttaagaagatggttgctgagaacaatgaattacgtgagcagttaaccaaggaaaaccgtgagtattacgagaatctgctggcttacttacgaggaaaatctctattgcgcgatgattatcaagtcgagcaaaatttgttaactattttgcaggacttaattgatgcccaagcggatggggttgatgccgctgcttattttggaaagaatccagaagcaattgctgatgatttgctgaagacgattccgctcaatctcactgactttttctggtttaatttaaaaatggtgttcatgatgctgtttattttctggatcccacagttggttagaccggttatgatcgttgatatcggtatggcacttctttgtggcatcattgctgttatcggcagctggggggttctttggcttctggcacatcacgcttttacgaaacacccccgtcttgaaacaatcgaattaatagtttatagcgtcattatagttatcgttttgtttttcatatctgttttttttaaaccggctggcgaatcaccctttcctcgcaaatatcgcttgcagttatcgtcttaggtttagctattgctattattttcccgttcgtccagcatctaaatgagctcaacattttcttctacctgtacgtttcgttctacttggtattgggtttgcttctgcgcctcccacaaacccggccgtttctaacagctaaagccaacttaggtccgtggaaatgggtcgtcaccattggtctagtactcttttcactcgcgattgtgggcttcatttactggttttatcaacgccgccatcaagactaaccgctgcgtgtggagagtattggtctgagaattcgcgccaacgggttttctaggccgcaaattcagctacaatagatggcatacgttccaactgaaggagtgactattttgatccctaatgaaaccatccggcaccagcttcaccaccgctcgattcggcaatttaaaccggaacagcttagccaacaaacgatccgcacattgctggatgtcgctcagcatacagcaagttccatgtatctgcagctgttttcggttattcatattctcgatccgcaaatccgggctaaaattgccgagattagtacgcaggcctatttaaacggtcctggggaattatttattttcattgctgacctgaatcgcgttgcctccttgaccgccgctgccaatcacccgcttgatcgcgtcgggcggatggacaagtttctccaggcaagcgccgatgctaccttggcactgcaaaatatggtggtggccgctgaaagcctgggtcttggaaccgtcacactaggcagtattcaaaatgatgcccaagccatgatcgatttattgcatctgccgaagtacacatttccattgttaggcttagcagtgggtttgccggctgaccagccagacgaaaaaccgcgcatacctcagtcgctggttgctttcaccaatcattatggtgaaccggcgccaaaagcagatgtactgagcgactatgatcaaacagtgcataattattacgccacccgtcatggctcccatcgtgaagagacttacaccgatctcgccgtgggtgccggaagctataccccggccaaacgcgctgatttatttgatgtgatgcgtcatcaaggcttcttccctgaaagctaaccgtttgtttttctttttggttcacacctatattgtccaaaatactaaccgtttgatgaggtgatcaagcggttattgttgtgtcttctgttgagcatttaaaatggataaagaattattgacccaccagtcaatttttgttgactggtgggtcaatggcgactatacttcggttgaaatgagcgatgattgactactgtaacgaaaacatcggttctcggttcggtcaacgacttggtatccgcacgcaccataccgtagaaacacgcgctgactcacgctcactttacttaggaggttagtcatgacaataaatgttatcgaacttgaccatattcaaaaaagatttggtaagtttgaggctttaaaagatgtcagttttacgttgtcgtcaggtcagattttaggctttttagggccgaatggtgctggcaagtcgacaacgattcggattattttggggttactaaagaaaaccagtggctcggtcaccgtgtttggcaaagacgcttggcatgatgatgctgcgattcatccgcggattgcttacatcccgggcgatgtttatctgtggccgaatttgtccggcggcgaaatcattgacttgttactccgcttaaacggacgcactcataatcaaaaaaccgatgaactgatgcaacgattcgaatttgatccgaagaaaaaagctcgtacctactcaaaaggtaaccgccagaaagttgccctcattgccgccttgtcacaagacgcggatctttatattttcgatgagccaacgtcaggactggatccgttgaacgagcaaacttttcaacaagaagtgcttaaactcaagcaggcgggcaaaagtgttttgctctccagtcacattctgtcagaagtggaacgaatgtgtgactcgattgtgattattcgtgacggcagcgtgattgaaagtgggaatctcgctcaaatgcagcacttatcgcgtttacgtgttgaagtcacgtcgacaacggctttggatagtttgacccaatcaaccggtattcatgagctgacctttccagagagacagcacacgaaggccattttcactgctgatcgcgatgacctaagtgcgatcatgcaaaccttggccagccacgcgatcctggatttgcaagtcacgccgccaactttggaagatctctttatgcgatattacgaaaaagaaggtgctgatcatgcggcacaataatcgtcatgctggctacctattccgggctaacctgaagcaaaacttcaaattttccggcatttggctcgtgattctcatcatgatgatcatcagtggggccgccaaattggaagcagcctttgcaaacggcacggctggggcgaaggatatcgtcaaaatgttgcaagcaccaggtatggcggcgatgtttggcgccacgccaaaagttgctacctaccactcggcgattatttttgctggcgttatggttgtgttcatgatcatcctgcaagcattgtgggtcatgccgctaatgattcgcgacacgcgggggcaagaagaaagcgggttactggaaatggtgcgtgcacgcaatgttggccgcaccgctgctgttactgcggctatttttgaattagtttttagcagtctcgttatgggactcacctacttgatcagcctgctcgccattaaaatggatggtgcgacccttgcaggcgacttgctatttgctttaggaatggtcgttgctaatctggttttcggcacaattgcactactatttgcccaacttgccaataacagtcggaccgccagcatgctgagttatatggtactcatgattgcttatctcatgcggctagtcaccgatatcaaccatcaacagctgacctggctttcaccaatcggctggtttgaaaaagctaacttttataccgacaacaaccctgtacccctgcttttagggcttatcgtcagcgcattgcttgcaggcgtggccgtcatgatcgcccagaaacgggatcttggcacggggatcattgctgaaaacggtggccgtccgcgagcggcaaactggctgcgctccatgcctgctttagtctggcgcaccgaacgcggcttgttggctggttggttagtcggggccgtcgtttttggcggcgtgatgggcagcgtgctcggcggtgtaggtgatattctgaaaaccaatccaatttatcgaaaacttttagatgtcagccaaattaacgctgccaatcaaaccatggtgctttcgtttttggcgatgtacatgggcatttttgtggctttggcggtgacagcgggcgttcagattgcctttcgactcaaacatgacgatcagcacggctatctcagcatcattcacgccgaaaagccgacccgcattttaatcagtgccagttacaatggtatggccttgttagctggcgttttggtgctgacagttggcttactcgccttgtttttcaccggcaatcaggtgctgagtcatccgctgccggcgaagtaccttggtcgactctttattggtggcattccagctgtcttggctttcattgcgttaggcatcgccttgtctggtttatggccgcgcctaagcagtcttttctggttgtatatgggcgccgggctgattgtgcaagtcttccgcggcttattcgatttgcccaaacacgccgccgactttacgccatttggctggattgcggatgtcccactcaaaacgctggctcaaccatggctgtccgtgatgctcattagcgccattatcctagtcatattaggaatggccggttaccgcagacaggacttgagcgtatgaaaaatgtcgtcaatgatccgcaaaaagtcacccgaattctcgcaacggctaccaccgcttttggccaacaaggctttgctaaaaccaaaaccgatgatattgccgcaacggctggtgtctctaaaggccttatctttcactacttcggtaacaaacaagacctttacctagatacttttaaaaccgcgtatcatcgcatttatgatcatatggacccccataaatggcaggacgcaccgggactagcgacgatgatgacacaggccgttaaatacgagatgcaactgcagctgaaatttccggacgaatatcgcctcatgatgcaggcttatgccgacttaccgcattttcctaaacccttacagcaacaaatccagcaagaaacccaggcaatttcggctgaagccaaccgcattttccgccaaaaaatcgagcaacttccgcgccgggatggtgtttcggttgctgacatttttagtgtggtttccgccgtcattgcccagcaaacggctaccactacccggatgattgcaaccggccattaccgcaactttgatgatttacaggttgtcgtggaccagatggatcgtcagttaaagattatcgagcatggttttttacctgattgataggaaagtcggtttagcttctgattgttatcatttcgcatcgaatggccgcattcaaaccttgcaaaccaagtcacccacaaaaaagctctggcacgccgctaccgcacaaaagctagcgagttgcctgagtttttttacctgtttaactaatcctgacttttagtagctttaaagagtcgcagatacaacccaaaattaaccaacccaatcagaagcaacaagccaaatgccagctgactgccgatcccgacgttttgagcatgggttaaacccggaacggtcacggctgtcatcatgccggccaaaaccgtggtgccaattgagccggtaacttgttggccggtactatacagcgcattggcgtcgctttgatactgatgtgccatcaccttcagtccataagccgtactgttaccaaatgccatcgagcggccaatggcaaaaatcaggtacagcaccgtgacccatagcacgctaatatgccgcccccaaatcgtaaagcccatcatgcccagtgtaaacaaactattgcctaacaagagtggcagccgtccgccaaaatgatccagcatccacccatatacaggctgaccaagtccattaaacacactgccaggcaacaagattaacccaccgacaaacgcgctggccccatccacggtttgcacgtaattaggcagcaagaagttaatgccgacattagaaaactgcaacaaaatgtaaggcaaaaagctgtacaggaagcccgcgtcatgaaaaacatcaagcttaaacaaagctttggcatgatgctttgacagccacaggaaaaccagcatggcaaccaccaccacaaggccagcaacaccggccagcgcccacgttcgatcactcaccccatttaaaccgaccgtcagactgatcagcgccacccccaacgcagcaaaccgcaaccagtcaaacgcgaatgcggaagtaggcgtgtactgcttaatccgcccttgtcctaaaattaataacattaaggcaaacggcagcgtactccagaaaatcatgcgccaatcaaaaaagttagcaactgcaccgccaaaagttggccccaaagccggtccgatgagaatgattaaattagcaacgcccatatacgtccctaacttgctggtcggcaccgtgtccaaaataatattcaccatcagcggtccgcacaagccaacacaacccgcctgcaccaatcgtccgatcagcaacacccagaacaccggcgccaatgcacacatcaaatcaccaataataaagagcaacgccgcggtgataaacaattggcgattggtaaagcggcgtttcatatacgctgaactaagcatgaccaaagcggccgctaataaataaccggatgtcacccactgcacggttgtcaacgacacatgaaagtcatgcatcaacgttggaaatgtgacattcatcgaagtttccgtcaaaacgccaaaaaacgacattaaggcgacaatagtgatgacgaataaggcgtggcgagtattctgttcttttgcttcaatgattgtttttgtcatgatcgacccttctgtatgcaactgccggctcgtcagcaaaccatgctggcaattgcgttatagtttcatgataggccggattattttcagtaacaacattgaatttcggcttgattggtgaaaattccgcttttggattgcgggttgcgatgaaaactacttgtgaaatgaggtaagataaggatacttgatacaaatatttttatggttttcggttatattaatcgtgagtgaacgtaactgcgcaggttcggtatagaggatggttcgcatgtcaacatagtgcgttcttcagtgcaaaaaccgggctggctcacgctcactttctataacgcgttctccagcccaaaaacctgcacataaggaccttggacgcaatgaccaagcccgggtcatcacgcccaaggccgcttatgctccggtttctaaccgggctggctcacgctcactttagtttaggagaattttataatgacaattatcttagtgcttctcggcttcttggtcggggcatttattatgaccatgggtggtggcggcggtgctttttatcttggtattatgaccggcgttgcacatctttcgccgagtactgcggcggcgacatcgctgtttacggcgattccggcgctggcggtgggctgttatagtcactatcgcactggcaatatgcgttttcacgctggcaaccggattctgctgacggcggtaccagcaaccgttgtcggtagtctggccgcaccttacatcccggaactggtttattcatgggcgattgcgatcattttcatggttcttggcgttcaaatgttgcgccaatcctttgggcgtaaagcaaagaagaccacccagccggcatggttcgcctatgtgcttggtatgattagcggcttaatggttggcgttgccggactaagtggtggcggcccgattatggctggtctgatgttgatgggtttggatatgccccatgccgctgcaacctcatcttatgctttagtagctttgtccatcatcggttgttttctgcacgccactcaaggaaaaattgcgtggacagtcggcggcctcctgatgctcggctcgctggtcggtgccgcaatcacaccccgcatcctcaatcgctttgacccgcgtaagttgaccgccatcttacgtccgctcctcggtttacttttggtcgtcatggcgatcgaacaagtatggtaatgattttcaacttaaccatcagttaaaaaatttgccagcaacttgaaaacgccgccattgtcttcactaagaagcaccatcataatgaaggtgatcaaaaggggtgatcatcatgcatttaaatcagattattcgcaataaacgcctggcagcaggcttaactcaggaagcgctggcgcaaaaagtcggtgtcacggcgccggctgttagtaaatgggaaaaaggtatttcctatcctgatatcacgttgctgccgattctcgcacgcaatctcaacacggatgtgaatacgttgttggacttttcggctgacttagatccagctgcactgcgtcgtttctatacgaaactaaccgcaacggcccaaaaggatggctggaaggcggcagttgctttggttgatgaagaactacgcgaatatccgtctgtaccgcagctgcaaatgatggtaccagcgtttcttcaaggtttaaaatctgacatcccgacaaatgagtggccagcagttcgggagcgaattattcaactttaccaagcaagtgaacgaccacattcaagtttgccagaagcccagatcgcagcggaagggttattccaattctatttaagcgagcacgaattcgatgcggcggaaaagcagcttcaaaatctaccatccgaaaccgttgcttatcaggcgctgaagcttaaactccagttgagccaaggacagtttgacaaagcttatgttgatggcgaacagctgcttacaagcgatttctccgcccttaccattgtcctcaatttgttaactcaagttgccattgccgatcaccaactggccacggctcagctttatgtcgatacactcctcaagtttgatgctgttttcaatatgtacagtccctgggcaattgattcacaactacgactcgcaaaagctgccaacaaacctaaagaagccatcgccgtacttcaaaagtccatcgacaagcttgatcggaaagttccggcagttctaaagcatttacctaagcttaagccaatcgcatcacttacagaagcccaaaaacaattagcccaaagctttgctgctgatccggaactggactatttaaaagacgaccctgaatttcaaaaactcatccaccagtttgatgcgtaaaataccttttggccaattaggcttttaggaactaccaaactgcaaataaaaacctcaccgcgaattttcttgtgatgaggttttttgtttgtgctggcgatccttaatggttaatcttccccgtacttaagaactcatacaagtaccgattcaccagtggattatgctcgtgtaatttactgtgttgcgccttgctgttggtaatctcccgttcggtgtaacttttggcacgatctgttacaaggtatcgtaatgaccgggctgagttaaccggcacgcggccatccgagcctttcccaagatttccatacaggttcaaaaccgcggctgttttgggaaaatactggcgatgctcgtacatcggtttgtaccgatccgacattgtacttggtcggccatcgctagccagcttaatatcaagaccactattcatgccgcccatccccggaaagccattgaaaggtccggcaatcgtaatgagtttctccaatgccggcgtcccttttttatccggcatgagcgaccattcggcccaagccgtcgaacccgcagaatgaccgactgcattaaaggccttaacgccatatcgcttcttgacttgttttagaatcttatccagcgttgatgcatctggccggccgctactaaacaccaccgcgattaacggatgccgaatacttggcgaccacgatccactaacgctaagctgtccggtgttggtcaccgtatatcgtaggacttggcggaatccgggatgtttgctgagatcgttaatcatgtccttttcagaaccatagccgccaccaaagccgtgaacaaaaacggtaggcgtctggtaggttccggcaacccgtttggtcgaaggggttgccccgcgattcagccacagccacgcgccgccgctgacaaccaaaaagatgccaatgataagaaagactttagcccattttttcgtcatcattcgcctcacttttccccagtagttcttgctttgcattgtaccacgcttaccctgattttgaggtttaagcctcttaatttcaaaatagttgtcaaacttccttggcaacgtcatcgcttaatgctatagtgtaatagatagctaatacactagtgaggagggacaccgtggaattcgatgataaggtgccgatttattttcaaatcaaacaatatctttatcaagccattattaccgatcggctcaaatcaggcgcgcaactgccggcggttcgccaacttgccgccgagttaaccgtcaacgtcaacacggtgcagcgtgcgttaagcgagttaattcaagaaggcgtgctcgtgacgcgtcgggggcgaggcaatttcgttactgatgacattaaagtgctgatcgacatgaaaaaacgcgtcatcggctccgaacttgaccatttataccgtcaattagccgacttgaatctaacggccgacgaaatgaaggacgctttttctcagtatgttgacgaacaggaggaacaccatgacaactagcatgatttcagcagaacatcttacttataaacgcaatcgtcacctgattttggatgatcttaatctcaacgtccaccaaggccacttcatcggtttgcttggtgcgaatggagccgggaagaccaccttgatgcggctgttaaacggcttggcaaccaattttaccggcaccattcaaatcggcgcctcagaaagcattgtcgatcgcaaacaactcagcagtttcagcgaatcactcaaaggtgtcaacgccagccgcacccttcagcaaattgccatcgattatgccatgatgtacatcgacttttctgaaaaagcgtttgcggaattcaccactgagtatgaattggatttgcaccaaaaactcaacgccctttcaaccgggaatcgtaaaaagtttatcgccgcgttgaccttggcccgcgagacccagctgtacttgcttgatgagccctttgaaggcattgacagtatgacccgcaaacgactcatcagcaatatgatcgcttggaagcccgatgccgccaccgtgatcatttcggatcatcacgttaacgacatcgtgaatattcttgatgaaatcgttgtgttaaaagataaacatattgtcgcccataagaacacggaacagctccgtgcggaaaccggcatgagcgtggaagcttactatgaaagtctgtatcaaggaggcaaaaccaatgactaatacctggaccatggcaaaagtgctgactcggcaacgatttaagactgcgctgaacacctttatcgtgaccattgttgctgctattatcaccgcaattttggtctattttggcggtgattcgcaactgtcagcacaattctttttcagtatgctttccccttatgtcctgtttggtagcatctacttatttatccggcttgccatcaaacaagaacatacttgggtcaacaattattaccgcgcagtgccgaccacaaatctaaagctttacgtcgcgaatttattcagcactgttgctaatttcgccttttactgcatcattgaagggcttgtattaggtggcctggaactttccggtcgtggcatgcacttgccaactgctagtgcctggccagacattatcgaaggcgtcattatcatcgcactaacttgcctcttcatctgggcatttgtcagcctcgtgcacatgttatccgtcaccatcatggcgttcttaccagaaactcggattcgtattgttcaatggggcatttatttagtcgtcattgttatcgcttcatatctattcaatcaactacagcgcctcttgttcatgccgttacacacttacaatttcggtgccgtgatcgctgttttcctcatcatctttaccctcatctctgctatcaacgtctacttactggaaaaatgggttgaaactaagtaacctcaccccatccaaaataattgattccaaatgaaaagcctgtgcgaccagttattggtcatcacaggcttttcgtttgacttcattcgcttgctgctggctaagtgaataaggcatttcttcatctattgcaatttaatccaattacgcttcagtttgcgccgccagtacccagtgctccggtgccgcctcgactaagtttgccgttcgtgcaatcggttcatggtcaaactgaacatgggtcttttgctgttcaaaaatcggatcggcttgtgggacagacgccagtaatgtttgcgtatagggatgcagcgggtggcgatacaccgcctcggttgcacctgcttctacgatccgaccacgatacatgacgacaattttgtcactaatgtaatgcaccatggatagatcatgagcaataaacaagtaggtcaactgctgctctttttgaattcgccgcaataagttaacaatttgggcctgaatggacacatctaatgccgagatcggttcgtccagcaccagaaacttgggttgaacggctaaagcgcgcgcgatcccaatccgttgccgctgaccgcctgaaaattcatgcggaaatcgattaatggcgtctggcggtaatccgacctgcgccaacagctgcaatacctgatccattcgttcctgatgcgagccagccaaatggaagttatcaattccttctgcaataatatccgccactttttgccgcggattcagcgatgcaaacggatcctgaaacaccatttgaacttgacgccgaaactgcttgcgttcagtacgggaaaaatgctgaatcgactgatccaaaaagcgcacatcgccgcctgaaatcggcccgataccagcaatggcgcgacccgtggtggttttgccagagcccgattcgccaaccaatcccaccgttgtccccggctcaattgtgaagctaatatgatccactgctttaatgggctggcggcctttatgaaacgtaacactcaggtcgtcaatggtaaacaatggtgctgtcaaatatcgtcatctccttttacctaagcccggctcgcgacaacggtttgtggttttgccgtcatgtccgcaaagcgatcccaccgtttttgaatcgtcactggcggctgatagcttggtgtgcgtggatcaagcagccacgagcgaacaaaatgggtaggcgatacctgaaacaacggcggtgcttctttaaagtcaatcgccatcgcataaggattacgcggtgcaaacggatcacctgtgattggtttacgcatatccggtggcgttcccggtagcgtaaataactgctcccgctggtcatccgaactcggaacggcatccaacaagccccacgtatagggatgctgcggattgtaaaagatttcattggcagtgccgacttccacgattttcccggcatacataatcgccacccgatcggcaatattagccaccacgccgagatcatgggtgatgaaaatgacacttagatcatgtttcgccttctgggtcttaatcaaatccaacacctgtgcctgcaaggtaacgtccaaagccgtggtcggttcatctgcgactaatactttcggatgcataatcaaagccatcgcaatcattgcccgttgccgttgcccgccggaaagttcatgcggatacttgcgggcaatcaaagcaggatcatcaagaccgaaatcttgaatagcagcatacaccgcttcttttaacgccgcgccatgtagatgttgatgtgctttgacaccttcaccaatttgacggccaatccgcatggtcgggttaaggccactgagcgagtcttgaaaaatcaagcccaattcctgaccgcgtaaatgggtataagtttttttgcttgcatgtaaaaggtcagtgtcaccatattgcatgacgtctgctttgacctcggcatccttacccagtaagcctaataacgcatgcgtagttaccgatttgcccgatcctgattcgccgaccaatgccagcgtctcgccttgatgcaaagtcaggttgacgccattgaccgcataaacattttcatttgcttcatgaaatgtcacgtttaaattcttaatggaaacaatatcagtcatgccgcgcccctttcatgaattagtttagccattttactgctttgtataaacgattctagatcgcgttgcttgtcagtacaaatacaaatcaattaacgcaccacccagcaggttaatcgctgccacaagtgccaattgaccatttccggggaggctgccaagaaagcgactggttaaagcagcatgcggtcgccgcgtgtgtagcagtaatttaatgccgactgcaagtaacgctaagccaactagcagccaaaaagtttgatgcaacccccacagcaaggccactaacgcgggctcatgcgtcagggaaaagccggttgttgtgacaaacaaaccgacaaataaagcggtgatgacttgccagggatgtttttgaatcatgatggtcctccttcatacttctcatcgcaactgcctgagcaacggcttttgggtgaagtcttcctgacgaaatacttctcgttgccggcagtcggttcaattagtcctgaaactttggatccaacgcatcacgcaagccatcccccagaatgttaaacgcaaagacaatggcgattaaaatcaaaatcgggatgtacagttgcagcggatgttggagcatctggtcttgaccattagcaatcaaaattcccaagctcgtattcggtgcttgaatccccagccctaggaaactaagactggcttcaccaaaaatgttatccggaatgctttggccaatatccagaatcaaaatactcatcatgttgggaaccagatgccgcgccataatccgccacaacggtgtatccaacatcactgccgctgtaacataatccaagccccgcaactgcatcaccaatccgcgagcctgacgcgctgatcctgaccaactggtaaccgccaaagcaaaaagcatcgtccacataccattgcctagaaccaccataatcagcatcgtaatgagcaagcctggtaacgaattaaacacttcaataatccgcatcaagatttcgtcaacccagccgccaaagaaagccatgatcatcccataaatggttccaaaaccaatggccaaaaaagtgctcaaaatagcgaccatcaatgacacctgaacgccaatgcaggttcgggtaaacaaatcccgacctaagcgatcagttccgaaccagtgagcggcacttgggccaacattacgactgttaacacgaatgaggttaggatcataatgttgaatctgtggaccaattaacgccgccaatacgattaagatcaaaatgatcccccaggcaacagcaagtcgatcctttaacaacttttggcgagccgatgcccagaaactgatacttttgggagcatttgcttcgatggtcgcgacttggtctggctcggtcagcacagttggcgtactaaaattgccacttgcctgaacaaaatgaaaatccgtatcacttgcagccattcgtccatctcccttcagttgtcatagagtttgattcgcggatcagccagtgtatacagtaaatccgtgatgaacatcgtgacaatatacaagatcgccagcagcaccgtttcgcccatgataatcggaacatcccgattattcagtgccgtgacaaaatattgtccgacaccgggaatgacgaaaatactttcgataaacaccgatccggtaataccgaatgccaaggtaaccggcaatgacgtaataattggaatagaggcatttcgcacgatatggtgtaagacaatttgcggctctgacaatcctttcgcgcgtgccgtcatgacatactcacttgagccaacatcgaccattgaatttttcaataaacgcgcataacccgcaatgtagccaatgccaccagcaatggttggcaggaccgtataaatccagccaccccaccaagtctgatcaccgcttggccagccaataatcggaaaccagccaagtttgccgccaaaataactttgcaagagcaggcccaacaccagactgggaattgacattaagaacagtgccaaaatcgtaatgacacgatcaatccaggtgtttttataaaccgccgccaaaatgccaagcaacaagcccagcggaatgcctagcagcatctgctgaatacctaaccgggccgatgctggcagccgatcacgaatcaaactgctcatggtcacagacgggtcactaatcgactcgccaaattgcccatgcaccatgttattcatcgtaatggcataacgttccagaaccggcttatctagaccagtgtttttatagacttgctcccgcgtggcttctggtaacttatcagtctgcgcactcaacgcatcgcctggaactgcagatatcaagaagaacgtcgcagttgcaattaaaaaggtcgatatcagcaattcaatgaaacgccgaatgatcaatttgatcataagtgtaaccacctgtttttcaaatcatggtttgtcattttctgccatctcccatcaatccgtacctacatcaaccaaacgcatgactcacgttctcggttgattactttttcgaagcataagtgtagttaaaggttccgccaaataccgttgtttgcagatttttaaccgacttattgatgtaaacctttgattgtgggttggttaacggtacgaccccgaagtctttggcaactaactgggtttccagctgtttgtacaaagccaatcgttctttggtgggcaagttgccattcagtttattatccagatcatcaaacgtcttgctgctataaccaccaaagaacttctggaagccattgtttgaattccacagactcaggtaagagttaggatctgctgaagccgaccagccattattcattaaatcgtattgattgttgttacgtatttggatgaagctggcatcatctggggccgttttaatcgttactttgacaccaagttgctgcttaatcgcctgcttcaaccaagtaccagtatcatcactgccaaccgttaaataaacaaagttcaacttgctaaggtcggtcgacttgcctaactcttttagaccttccttcaacaatgcctgccgcttagcttttgtgttgtattgagcctgggcttctttcaatggattgccgacatatttgccgtaattggtcgacccgacattcagcgttggcggtgccattgtgtaggtcaatttgtcctggccatcactgaccgctttattgtaatcatcgcggttaatggacaatgaaaatgcttcccgaaccttcgtattcttgaacaatccctgcgtcccgccattatgctgattcataatcaaaactgtggtaccgggaccattttgcgtgcgtgaaaccaatttattactctttgcaagtttattaaaatcggcaatttgtttccctgaggctgacaaagcatctaactgtccgctttgcattaatgacagcacggtcgatggcttgtccgtcgttgtgtaagtaactttctggagcttaaccttcttggcattccagtacgatggattctttttcagcgtgatcttgtcattctttttccacgctgttagtttaaatggcccgttaaagacttgatccttcacgtcagttttccacttcttattaccgacttgattaatcttgtcgaggcgaaccggataatacacaaccgaggagagatctgacaagagtgacgggtaagcataagcaagttgaatttggagggtgttcttattaattgctttgacaccaacgtcttcagcactgccttttcccgtgttataagcttccgcacccttgatgaaataggcattagtggcctgtgaaaaggcgttttctttcttcagcaaccgccggaaggaatccacatactgctgagcggtcacggctttaccatctgaccactttgcatcccgcaacttaaaagtataagtaaggccatcagccgacttggtataagatttggctccggtcaaaacgactttatccttaccatttgtcgattgaatcgccgtcaaaccttcctgtacttcggataaaatatcgttctcattagaattgcgcatatcgttgacatctaatgttgtcggatcatccgattcagttaagttaagcgtctgcgcatttccagacgccgaactactttgaccgccacaaccgaccaacaacgtcgcaagcgcagcgcctgtgataagtgctgttaacaaatgatgcttcttcataaaagccatctcctaaaataaagtgagcgtgaaccggcgcgggtagaagtcggagtgtaagcggcctcagacgtgatggccgcactttggccattgcggctgaggtccttacacgcagacttctgcgccggtgaacgcgttatggagcgtgagtcagcgcgggtagaagtcggagtgtaagcgaccttgggcgtgatggccgcactttggccattgcgaccaaggtccttacacgcagacttctgcgccggtgaacgcgttatggagcgtaaatcagcgcgcgagcagagctcgaagtgtcaccaaccttaaccatgatggctgggccctaaattggccattgtggttaaattgcttaccttctcattcctccgccattaaccgcgttataaaataaaaactggcggtgcatctaggattctagatacaccgccagtttcgttcttcgttcaagtcacgtgatttccgtcacccaagctaatctccagccatgtaaatagaaccactatgtcgttcatagcagctgcacatgcacatggaaatggcttgaataaattgggtcatcatgttaactcccttcgaagaaattaaagttagcatacgtttaaaaaaatagttcgtcaacggttaatttttaaaaagatcctcaccagcccgcctaaataacggcgacataaactgctatatcagtcctacctagcgctcagtggcttttaatcttctttaaaaaaacggccttttaattgcaaaattaataaatcaaccacagattgtactgaaaaaagactttgaagctctaaaactggccaccttgtactacaaatgaacgataggcccgtttttgaacaaaatgagtttgcgtttatttgaaactgttttaaattaaatataggtatttatttttctcatgaatttaaacaagtggaccactttcttcgtgctacggcaatttttccattaaaaaaatcgactcagtaaaacactcagtcgactttttcatcttcatgtgctcgcggttttatgcctcggtacgacggtggattaacgtccacaataacgcgatgcccgcgccgataaataaaagcgcagggatgacattagctgccgtgaacatcacaaacgccatggtcgcaaacaggccgccgatcgaaaggccaatcccccattgctgcatcgctgtcaggctggcaaaggaggtacggaaaccaagcgccaacagcaacgaaccaacaaatgcaatgaggccaaatacgatatgtcccaaaatcaaccagttaaacattctttatctcctttcttggtatcttcactatacggaaaatgagagcgcttgccaattacttttattcaaaacttggcttcattcaaccgtccatgttctaaccgcagcgcgcgatcccaaaattgttcaacatcttgacggtgtgaaataacaatcaatgcgactggtagttgacgcaatcgctgactgaggctttttgcagctgcggcatctaaatttgcgaagggctcgtctaataccaaaatattccgttgtgccaaaagtgcccgtgccaaaccaatcttttgtaattcaccggccgaaacattggctcttgtctggccatgaagcggcgtggcgagtccttctggcaatcgctggacaaatgtctgtaaatcagtctggactaacacttccgatagtgccgtctggcttacattgcggccaagcgcgatgttttgccgcaacgtatcatcaaacaaagccaccacttggggtacaaagccgatgatgcgcgcaagttggtgtgatgtttcaagagtgtccggctctacttgaacgctgcccgcttgcggtgataaaagccccaagataattcgaatcaaagttgatttaccgccaccgcttggccctgtgatcagaatcttttcatgtgccgccacatttagctttaggttcaattgcgccaaaaccggccgagatgcatctggatacgtgtaagtgatgtgtttgagaagcaactgttgtaccgagttttttggctggtgagctgagggcgcttcttggctttcagcagcaatatttctcgacgctgcttgtaccggcacaattaacccgaagattcttttagctgcaactagattccgtgataactgcgcgtactggcctggcatactgtaaaacaaccaggtaaaactgggcgtcagcattgcaaaagcagcaaattgcccgatggagataaatttgaaaccgacaaacagtaattcaacgcccaaaatcacaatatcaacgaataagcccagtgcaaaccccatgacaatcgtaccggtttgttgcaaacccatgcgatattgggaatcggcaaagctttggtatgttcggctaaatagttgcaaaccaaactgttctttttgataatcttttagaagcatacgtccggcgagaatttccaacagtgctgcttgcatccgcgcattttcagattgttgcgtgtcttgtgcctgggttaaccgaccggccatcactttaggaatcagcaaagccgtcaagcacaacccaataatgataagcatcaacggccaggagcttaaccagccaaatagactggcagcgagaaatgaaaataatccgactaaaatagccgttaccgatttgataaacaaaggtgctgctagtggcgcttcggttgtcaaactattgacccgttcatttcgagctgcaagatcaactgcaactggtccgttcattagtgctgccattaagcgtgattgcagcgtttgggtgagttgataatgtgcctgcgtttgccagcgtgcgatgagccagcgaccaccgccaatcacccctgctgctacaacagccatcatcatcaacggcatggtaagtgcacctcgctgggtcaaccgttgaatcaaccgcgctaacccaaactcaattgcggcacaaatcatggcaataatccatagcactggcacaatccgcgtactaaaaagatgccaaaactgttttaattcagtcatcttattcacccaccttaatgatttgatcagcagaagtgacaaaatcaaacgtatgcgtgatcatcaaaatgccgtgagtgtgggcagcctgtcgcaacacttgcatcactgccatctggttggcagcatcaatatctgaaaacggctcatccaagactagccacggacgatttgaaagcaaggcgcgggcaatgccgaatcgccgctgttcacccggcgataactgtgcaggttgaagaatctgattgaggtcctcagcatattttcccaacccgagtttttccagtaacggtcttatctgaggtgaagaagcctccatgtccaaaagcaaattggctgtcaccgaagcggtaaacatcacgctgcgttgcggcacaaaagccattaattcagccggggtgactttatctacggatccctgaagcctaatctgaccagatgttggcgtcaaatcgccgaggatcaatttcatcagcgttgttttgccagcaccgtttgccccaacgataaaagtgatcccgcgattatggatctcaaaattcaatccgcgtaataattggcgctcactatgcggataatgaaaagcaacctgatcgcctacgatagtcaacagttgtgccgaattgacctcggaaggcgcgatttgaacttttgacgatccctgcaagcgcggcaaaatccggttcagtgaggtccgttgttgcgcgagatagccaatggttggtgccaatcctaaaaacggccacagaatggaccccaccccggcattccaggctcccaaaacaccggcaacagattgatgcgtcagtggaagcaagccaaaccccagcgctagtgtcagcacctccgccaaataaatgccgccattaaaaatacctgccagcgccccggttgcgcctgccagttgctgaatagccggttgtgcttcctgaaaaatggcctggtgccgctgccgaatataaccaaagacattcagattacgaaccggttcaaagtttgccaaaaagttattgaaaaatcccttatgccgatcatccaccgcaattaaactggtttgtgcctgattttgacggcgaaataaatggcgtgacaccaaggcaaacaaaagcccaaatacaataaaagccacagccaactgccaagattgcgtcgcgacatacaccagtcctaaactaactgtcatgccaaaatcaaccaacggcagcacaccactgtccaaaaattgcatcacattctgcgtatccgagatcaataaattcgttgccacacctgcatccggtgcatcctgcgcatcccccgacaagaaacttgccatcaacgcccgggcgactgccacactcaagcgtcgttttaaccgttccatgacaacgcctgacagccagtagagtccggtgtagaccactgttgccccgagcatgccagcaaaaacacctaccagcatccctgtgcgacctgttaatgcagcggtcaatcccagctgaatcaacatcgaaatcgccacattgaacccatcaatggcaacccgtaaaatgaataatcccaataaccaccgtttcttcaaggcgccgatttgcatgattgtctgcatagcatatcccctcgtttcctccgactggccgaaccaatcgtaacgactacttagggctgcacaatggcaaacaaaaagacgacctctcagccgcctaacgttaatccaattttatgaccgaccgaaagtctacctgcgaagcgcatcaaagaaccctgcaccaagcgcagccccgacattaagttttgatggggtaaatcggtctttgatccgcattggaaaaagcctccgttcgacttgttattttatgatgcaatagtaccaattatttggtcaaaaggcaacgaagaaggtttgtcatttcaaaaaaatctacggtgagtttacaaacattcacatgctgtgcgtgccttttaacgttattgactagctcactgcggttagacaaaaacgacactgacaacgaaattaccatcgccagtgtcgtctaatttacttattttctaatactgccgcgaataactagcaagtagcgccactcatcataatgcccttcttaaacgctgccagcacatctgaacccttagcaattcgaacgcttccgtccaaataagcatgagcgtcatctttgatactgatcgcaccttgcttaaagtccatcgccaagccgtttgcaaagaaaatcatgtcatagtcggacgtgtaaagctgcaacccggcatcattttccaacttcacttgataatccggatccggttcatcaaggacaattaacgaaaactttgtgccgatactgcaggccccgccttgtaaggaataccgcccgccgccatcatcagcaatcaacaacagaatcttctggtcaaaatgcttcttcttcatcaaatcaacaaacgactgcgataacttgatcgttgccatcataccgtcacctttcctgttacttacttttagtttgccactttttgtaggggaaatcaattgtgcgcgaggaaatttgccattaaatttgaaacaacgacaactgctcgtacatcacttaccggtttacttgcatttaaagatccagtccccgagtgctttgagtcatcattgtttgaaattgtttaacaaaggcaggctgattgaattgaatcgtcatgccgctattacgttgaaaaccgttgtcagaagaaaaccaaagttgttcttctcctaaaactaagcagttaggtaagttgccattgtaaaacgtataagacacgtcatttaatcgtttcagctcgacttctttatattgatcctgattcaaaatgacctgaatctgtccatgattggcttggacaatcgtcatcatattttccataaatctggagagttggtttgctataatggttatcttattaaccgcgattaaatttcggcgcaggtctttttgataatcaccattataaacgcgcaatcctgactgcttggaaaactgatcttcggttatcttgtaatcaaggcgtttgtattctttaagacgcttatgatacatgcgagcaagcatcgggattgacggatcaatataatcgtaaactcgtaattccggtttggtgctcaacgaccgctgcattcggccaagaaattgaaccgcaatgcctttccacgaatatggcatggctaaaatgatggtatcgataccacttatgtctaacccttcaccggcatactttcctgtcgcaatcaatgcataagccgcctgtgtttgcgaaacttttgctacgatctgatcattttcctttgatttttggccaccataaagtttgtagacgccttgctccggtaacgcctctgccaactgttcaacatgcgcacgcaaatcggtcaataaaagaacatgccgaccttctgctaaattggcttggacatctcgaactaatgctcggttacgctgctcatcatttaacattgcttcacgattttgcgtcaggctgttatttgccatttccaaagacagcatacccaagctcgtgtagcggggaatgacatttcgctttactttaagcgcgaactggctatcaatggcatccgtttggtaacgaattggtccatagcgcatgattaagatgggatcttgtccatcgcgtcggtacggggtggcagataatccgtataagtattgcgacctgatccgcttaatcacttgatcgtaagtgtaagccgcgtcatgatgaacttcatctgaaatcaccatgccatagtccttcaagatattttgaacttgaatatctcccgtcaaagactgaatggttgcaacatcaatcacaccactgcgatttttcttattgccaaaaaacgtgccgatactgcgcttatgccgttttcgaccagttcgggttaactcagtcaaaattggcgctgtttcaacctcgagaaactgattcagtcgagtaacccattgttctgcaagcgccttgtttttaactaatatcaaagtgctaacctgatgcttggcaattaaggctgccgctatcaccgtcttgccaaaacctggacgcgcttgcaaaatgccggtggaaacttttcccaatgcggtaaatgcgggtagttgatcagggcgaagttgccccttaaatgtagcctttatgggtaatcctttaatcgtctcgtcttgccactggatatttggaatcaaaccacgcaacctatccgctaacccacgcggaagcagaagatattgatgattttcttcaaacaggctgataattcttggaacgccaaaagtcgactgacgctgggcttcacgttcatagaatttgggattgtgaaaagacgcaagatatttgagactcataatctgctggtcagtcaagcttgttttgtcaatatataaagcgttggcgtgaataatggtcagcttttggtcaataacaagaggttgttttagtagatctagctcactgtcctgatcatcgttatacagtcgaaatacagaccgattcgctaactcgttaagcaattgatcaatcgttgctgcatcaattaaaccgactcgttccaacgcctgccactgatccgctaacggtttaaacgcgtcatcgacaaagctagcaaaaccgtgcaagcggcgttccccttgcaatggcccagcaatcaggttgccgatttgaccatttcccaacacactttgactaggaaacattcgatcaaatgcggaaaacgaaatgttggtgttaaccgcacttgccgcttttaaaatcgcgtctccaagccttctcgccaatcctgctgcaacgggttgagcgaaaaagaaccaaatatgagctccttttccagactgcgataattccaccaaacaaggaatattatatttcctacacaattttttgaccgtcatcgtcaccgcttgccagtgctggccttcatgatgaccatcaaagtccaagataagttgcttagtcgtatcgtctttcagcattgggtaaaaccccaaaaattcttgtccctcaagatgatcaataagatcttgatcggtcaacggtgcataagtacctttaactggtcgtctatctttaaaaaccggaaaaggcgaataaatatctttctgtgcttttttattaaaatagcgatgtgcgtaaacatcggtgcggccaacaattcgcgcacgataaagcgctacatgagcagccaaattattccccgagcgtatttcaagttcactttgaggaattgaacaatagttgttactagcaatatcttgcagaatcacaattttacctaacttttgggcgctcaagtcctgcgcgatatttatataaagatattgctttccatctatcgtgtaggttttactcatcgtcgtcaatgtccttttccttaggcctttaataaaagcgtacccaatcaattaatattaacaactactttacaatatcattgatggttttgcacatgaaaagtaaagtaaagtcacatcaagacgactaacaaccttcaccagtttcctcaatcccagtgattaaccgaattttactccacaactcctggacagcagtcggttctttttcaactcctaccaataatccttttaccaaccacaagcgaactgttgctaaaaagagtggccgatcagcttcactaataccagctaaatggcaaaaacgctcagtatagacagatagtgcgactccctgcctcggcataaaaccatgataaagggccgctaagtccaaaaaacgcggaccgcgacgagcttgtccaaagtcgatgataccaacttgcttattcgtcattgtgagcaagttccaccgtcctaagtcgccatgcacccatgcttcctgagcttggtcgagcaagagcatcgattctatctgagaaaccaaatgtgcataaattgccggctgagtttgctgcaacttggcatgctgcttttgccacagttgctgcaatggctgcggatcttgtggttgccaatcatattcaaactgatctaaacctttccgaatttttagataacaacttagtgctgccgctaatgtaggtgcagagggatggtgttcccagaatcgctgaacttgataaattttcttgttcacactgataaatggttgctgagcttgtgttaacaaaattgctggcgtcaagtggctatcaacgtcttgaatagcttgtgttagcgcaaattcaagcaaatcctgttccgtactgggaactgttttgaccaaaaccggtcccgatattgtctcaactcgccatgccatgctgcttttaccatttgtcattggaatcgtttttgtgacgcgaccaaggttataagcaaggagcacgcttgataaagaatccatttgatcccctccactttttcaactgatggctcgctaacaggtttctccggtgagatcgttcacttgtgacactaccggatgacgattccctacaaaaccgttaaaatatcagtctaaagctgcacgacaaccacgtctaagttagcatagaataatcgtacgcagtcagcaaattcttttttggaaatgaggccaatgggcatgaaacaccgcaaccgtttattttggctgatcttgcttgtggcaggcgtttttctggtttatagcaccgaaagtccactcccgttcacaactcgcgaaacagtgaaggccggcatcgcccaggcatgggctacaacaacgcacactgttggtaactggctgcacggcaattcatctgcggactcggccagtcaaacctcctccaccagtcttgcctcaagcaccactagccaggcaacttcacgctcggcaagtacgccagcaggagccaccccggccttgaatattgtccaaggccgacaccttaagcgtacttactattaccattttgacgccaatttaccgcaagcagaacacactgttttcaccaatgccgtgcgcgcttacaacgcaaccggtattgttaagctcatccccggtcaaggcaaaagaagcgacaatcagatcactttttccagttatcaaaaagacatgagccaagcaagtcttggtaccaccgaacttggagaaggcgggccgaccattatcgtggaaacgctaggcgcacaggttaccgttatcaaccatgcccgcgccagtctcaacctagcttacccatcacaatccattaatgcggccgtggccatgcatgaacttggccacgcgctcggactggatcatagccagtcgactgattcggtgatgtatccagtcacgcgcggggttacgcaactatctgatggcgatattgcagggctcaaggcgatttatgcccaataagcagcctgcttgcttacatggaacccaattcttgctttggctttactcacgcatatctcaaaaaagctgtcagagccttcatatcagcattgagggttctgacagtttttgccttattagtatttgccagttttcaaagtgcatgttgactttgttctgtctataaaaccaccgcgggaatcggacccgcgtgtaaaatgttaaacttcacagcaccagcgtggttagcgatcggtttcgatcagtggttcatcttaattgaaggttccatcattcccggttgcaacagcagttgaagcggcatagaaatcaccttcatcaacgacgtaaacgccgatgacgatgttcttgtagccagagttaatgatgttttggtagtgaccgcctgtttcaccgtggttgttttctggacgttcatccacaatgtattgtttgaacatcgcttccgcaatcaaagtgctcagcttatcggcactgccatcgacatccttcttccaaagcgaggaaattgaaatgttctcagtatttcggctcatgtaaggctcgcctttttgataggtgacggcttcagtaccacttgctggtgcattaactggccgcgtgtgactgaacttgaacataacctcaacggcgcgcggtgcttccatctcataagctttcggatctgaagttaaggaagtttgaacatgaccggtacgcttctgttcaccattgatcagcacattgaacttcttgatgaccgccatggttagatctttgtccgtgtactgtgcagcttgttcaatcgaaactttccgatcattcttttcgatctgcgtttgaatcagctgcgtggtagcatcgttgacactcttaattgcgccgataatggttcctgcagcttccacattgcgccaaacatttttcgtcgtgatcgtcgtcgttgtatcccaagtattcggatccttcgatactgttgtaattggcgttgacgaaatcttgacgtaaccggtcttgtcggtcaaggtattgccgccttcgtctacgtcaacttcttttgtgacggttttggcttgtggcttgtgatacgtgcttgtgtaggtcactgttgttgtcttgtgaccatcactagtcgttaaccaacttgtagctgatcctccaccaatgtaatcatacccatcagtagaagttagctcgtggccttgatcatcaacgttaacaaacttattgatgattgtttcgtttggatcggtattctttttccaaacgttggtcgtggtgaaggttgttgtcgatgagcttgggtcttctttagacgtttttgaactgttaacaagcgagtaattgtcaacactagttaaaacgttacctgcttcgtccacattgacggtcttgttcacaatggctggcgttgtgacctcgttcttcttccaaacaatcgtggtcgtaactgttgtggtgatgttaccagcattatccttggtatcttccgacttactggagcgagaaacttctgtatagccagccgtgcttgtcaaaaccttgcccgactgatccacgttcacagtcttgttgacggtggtgtgggttggcgtctcgttcttcttccagacaattgtagtcgtaaccgtcgtggtgatgttgccagcgttatccttggtgtcttctgacttgctggaacgtgaaacttctgtatagccatctgtgcttgtcagaaccttacctgactggtccacattgacggtcttgttgacggtggtgtgcgttggcgtctcattctttttccagataatggtggttgtaaccgttgtggtaatgttgccagcgttatccttggtgtcttccgacttgctagaacgtgaaacttctgtatagccatctgtacttgtcaaaaccttgcccgactgatccacgttcacagtcttgttgaccgtggtatgcgttggcgtttccgtcttcttccaaacagtggttaatgtaaccgtcgtcgtgacatcgccagtcttaggatcggttgattcagcaacttgtctcgatacagaaactttagtatagccatctgtgttcgttaacgcatttccggactgatccacattgaccgttttgttaactgtctgataggcaatcttatgataaacattggtcgttgtataagtcgtgattgtgtcaccgttgctagaagtctgaaccgacttaacaggcgttccggcagtgatgagtttgtacccgtccaagttgttgagcgtctggccattttcgtctttgttgatggtgactttcttgtcagtgttctttggcacatagattgttggcaaagtcttcttagcgtcagcaactgatgtttgagcagcttctacagtctgttgatggtcggttgtgtcgactttttcagacttggttttagcagcggccaagtctgtttgagctgttgcagcatcatcttgtgccgttgccaaacgatcttgccacgttgcaatttgagcgttaagcgtatcaatcgttgtatctaattggtttactttgaccttcaaatcagccaactgagctttaacggtttctgcttcttggctgttttgactcgtcacggatgcgggtaaagctttcaaagttgtttcagcttggtcaaattcatttcgggctgtcgtagcctcatttttaaccgcattaaccgcttgggtggctgcggttaatttttgtcccgcttgactagctgtttgctttgcttgagtcagagctgtagttgcatcggctaactggccttcataacttgtcagcttttgttgtgcaactgccaactgggcttttgtttcattaacctttgattgtgaatctgggttggtcttcacttggtctgccagcgtatttagttgattctgcaaatcgctcagttgtgtggtgacgctgttgacttgggctgtgctctgatcaacggcggcttgttttgcagccactgccgcatttgtctggtcagcagctgtttgtgcttgctgtgctgctgtttgagcggcttgaagcttttcttgcgtggccgtcactttagctttggctgcatcaactgccctttgcgccgcggttcgtttggcttgcaactgcgccaatgtctccgtattttcgttgttcaacaaggcggtcaacttagcttctgcttcacgttgggctttttcggctgctgctttttcagcttctgctttatccttcgccgcttggatcgcttccagttgtttttggagggcatccttatcggtacttccaggattaggtgtgacagcaggagcagatgacgcgccaccagttgaagtgccgccagttgatccgccaactacagtatatttagcctcagcttgttgcgccggtgtaagggtagccggttttgctggatttaaattaaatgtttgattatttcccgagacgtcttgcgtcgttactgtcgcattgtcaccactaccttgcagggataacttggcgccggcataaatcaagtccacgttggcaatccgattaatggctgccagtcgcgctactgatgttgtgaagccggtgtgattcagcgcttcactgatcgttgaaagcgtgtcaccccattgaatgttgtaattcgtcgagcccgtcccggaagctttaatctgtgcttcgatttggcttactggacgaactttccaaactcggccctgattggtcgctgtttgctgtgttgcaggctgttggtcacttgcatgcaccacttggccctgacttgacaaggcgattcctgcagtccccattgcaaaaaacgttaatccaattgccaaccagccatgatgcttactatgaaccaatgtcaccttatgttcgttgtttgtaagcgctgtccaaaattttcgccgcttcgttgttcccatttgtactcctccaaatcctttaatattaaatacaaatgttattatacttctattttcgatttctttatacaaactattcaacaatttttgtaaaagttaccaaatcttttttacagaatcaatttacaaattcacaatgatcaaaaccagcgtaaactaaaagaatatcccgccatagacaggatattcaaggcacaacttactaggaaaagacagatcctgcaagccattaaaataaactaatgatatacgaacggcagcgataatcttcgccccacacgaaaattgtcgccacacagactgttatgttttgtaagcatcttgtcgaaaaaagaacatccccatatgcttttcatgatgcgttcaaaaaagccggcttgatctgcctacgacttgcagctggcaacatgattgaaagtatatacactaccaccccaacagtggcgcaaaccttatccgtccgacgattccagcgaataacaaggtttaccatggcaattgctcctcacatcatctgtcaaccacaaataatattataaagctttatggtctaataagtccactttttttaaaaatatgtgttatttagccctaatccttcaatccggagtcaggtagcgttgatgttatgaccaaggcagatagggggttaagggatgcggttacaggaaaaggtcgccaaaagaatccacgaattaagactcagcaaatccatgacccaggaacaactagccgaaaaagccaacatggacgtttccatgctagccagaatcgaacgcggaagccgcggcgacatcagaatgagcacactagaacgcatcgtttccggattagacgtcagttatcaagaattcttcacttttccagaagacggagatgaaacaaccgaactggcttcttcaatcgctttgattaaagatccggaagttatccgggcactccacaagatcgtgaacacgttgattcatagggacaataagtgataaccatgcgtaaacgactgatcatgaatttatttaatccaacatcttttcttatatttttgatttcaaaatggcaattttaaattcttcctcttgtttttaacgtattcaatcaagtctcatcaaaaaagccgccagttttgtgcaaatgcacgcgactggaggtttttatgtgcgataactaaagagtgaaagttgaatgtccggagaaagtcccgagaagacgggacttttggtgttaggcacaatgccgtctggtgttaggttaggcacaactttattcaggatgcaaaatatggtagactaaaattaccgatcccgatatgatactattcgacgttggtcgcgggtgagactttcgcaatgccagccgctggtaatgtcaagcatatttgctcgataatgctgttagcaagtgcagacacgatgtatttattcatttggctgttctccttatggctgactaacgacacaactataatgttaaccactataattgtaatgttaattgtattcatctgtcagacaatgatagatgttattttcgaagcagtgtatccctgcggagataagatagacaggcgagactttcgacaaatacagtcgtttaggtttcgcctgatttcatttttagctttaaagtcattgatattgcaaaattggcggaggaaatttcttggatttagtgacacaggttggtttacgtgcgcttgaaagaatcaatggtaaagattacttgcattttgactttccagttacagagagtgaaaggaaacagttagtttcggatattgtaagtggtgatattgtccatcaccgttacttaccgtttatttcttttgaaattcgatttcggatctatcacgctcgacaaaagtcagttcaggctaaagcgcgaagaattatgctaccttcccatcatgatgctttgatgtatcgcttttatggccaagcattgaatcggctatactctgactatgctttaagtcatcacattaacgatgttgctgtcgcgtatcgcgaacgacatcctggagtccatctttcaaacattaccactgcaaaagaagtctttgaccgcataactgcattgtcgaaatcatgggttattaagggtgatttccatcattttttcgacactctatctcatcgatacctcggaaccaatttacaaaaagtttttagtggaaatctgcccaaggactggaaaaagatgtttcgagcaatcacacaatgccaatcgatcagtcgaaagactttagaaaaacagctgcaaacggcgcatatcaaagttgcctaccggacgcatcattcggatcagtccaatgcccgcgcatatgtaaaaaatttacaagaactcggcaaactaattcaggacaagaaaattcgtctttctgggaaaaaccgtgtgggcattccacaaggtactgctgttagtgcagtattagccaatgtatacatgattgactttgacgagtggttagcaaaattgtgtgagaaagagggaggactctatcgccgatattctgatgactttattatcgttttacctcaaaaacagtttagtgaggagtccgtcaaaacttttgcgatgggagttattcagcgaagcaaaactgaactgggattaaaaattgagtcgacaaaaacaaaactgtattcatatgatcaagacaaccattccgtgatgttataccctattcaggaaacaggtaaacaacgctcagggagaattgactatcttggattcgtttttgatggtatttctgtttcgatgcggtcaaagagcatttacaaatttatctatcgaggaagacgaaaggtcggcaagtatgtcactcttggtcgattgtatgatcaggtaaagaatggatttagcgattcagatatcattcaaaatcaaatggcctttaaatataatacacgttccgaaaaaagtaaaaaaagacctgtggttccaaacatatatcagacggtacagactcttcaccgacttcagcagattagagaaatgaaatatgagacactgcgcgctattcacaaaggggtgacgatccgatatttaagtgctgaggtaaaaaatccaagagcctcaatgttagcgtatgcttcgcgagctcagcagatatttgaagttggacaacctaagtatcgaattgtcattcttcgtcaggtattgcgtcagattaagcataaccaaaaaaagcttcatcaagggcgggataattataagcattggcgatactctaaatatcaattctaaagagtgtaagccctttaagtcggtccgtctttcgacgttactcactgcatcgagctgaagctgatcccaacttttcaaaacggacaaggcgtaattgcttgaatgatgctcgaatcaattggcagcggatggttctactggtagcggttcgtctgattcaatacctccatcaatttgtcgtgagcggccgtgatcaagccttcgtcattgacgattcactatttagtggctggtgatttaggttgcggtttctggccgaatttcagtcactttatagttgatttgataatgcaggccaccctgttcgaccacaatagaaattggtacagaaaaaagcttaaggaggaggtcgatatttgccaatgcaatcgcgctatccaccgttaccaccaaggactcagccgttctggtgttcactaagtcaagcccaagtgaacctttcaagaaggcaaacttgcgctcaatggcaccccgacgattttccgcactgacatcggctttgcgctgtttcggatccacatgtttgggctttcgacccagctttggcccattaagtttaatgcctagcttcttacacagattgatgttatctcgcgtgcgatagagagtatcgaccagcacctcatccggatattcacccactaggtcaaaagcatggtcaagcgttacttcaagatcagtgctttcgttaaatgaattgaagtcgaaacgctctacatcaatcacgccatccaacatggaacagtcaatcttggcgccaaactcaacggactgctttgccttacctcgcacgattggccggatatacggctgttgaaggctaacgatgcgattctcgacatggtgagtgtggttctcaaacatgaagagctgctgctcatagacttgtttaatcacttccagacgctgtgcttgccaatcagtgagctgaccgccttgcgcaagcagttccgccacatatcgcagatctcttcggatgtattgtagctgagcttgaagctgtttgcggcgttccttgttttgacgccgcggtttcctcgaaaaagcggtccacttaccttttgcttcacgtctgtatgtccgcggaatttccacacctaacccgtgggccagatctgtgaccatttgttcgagattcaaacgactctggttaagcagcgttggaatcttggggatacttgatcttgaccggaacggcagtcgcatcactaatcaaaacatgcgtcccctcaggtagatcggcctccaaccgctcgcgcgtgaagtcattagtaatgttgcggatcaaatctgagatggctgaaagccgttggcgaaagtgcaccaacgttgtgtgttcaaatggcttcttagcgcgatattcgggtaatccgatgaagtactgataggctggtgtatcacggatatcgtcgacaacttggcggtcggtcaggcctttcttcaacttgatcaacgttgcgccataaagcaatcgaaatggcttcgctgctcggccggtttttgaagggaactgtaattggtatgcctcttcaagtttggcccatgggatcaattctgcatattgaacccactcgttgtccgggctgagcggtgttcccagagcgcttccaaaggattcaagtgacagttgcgttgctttttgacgataaaccatgatcaattcctccgataggtcagcgataagtgcaagggtaaatcccaaagcataggcatttcgggcaaatgaggcttgcacttattatacgcttaactattggtaaagcctattatgaaaacacttttagagtttttcaccattcactatttaagcgcgagttctccaagaagaccgaattactctccaaagtattcgatcatgaccatgaacggtactataccggctttcgggctttgactttgggttggagtgatggcaataccctcctgccgctcaactttgccttcatggcctcaagtaagaaaaagaaccaagttagcccgcaaaagccgtgtgatggtcgctcacttgcggccaaacgtcgccagcaagcccatcgcaaaatgaacctagtggccacttgaactcgttgatcaggcgattaaagcaggtgccaaggcacattatgctttatttgatagctggtttgcttatcccaagatgttccatgaactgcttaagcgcgggatcaatggcatcggcatgatcaagcagacggagaaagtgtattttcgttatcgtggacgagaaatggatgttaagcggctctatgccacgttaaagcagagtaaatggccaacgcatcaacattatctgtacagtcccattgtgcaatacgacatgggcggtacgacgatggccatgaagctagtcttcgtgactaaaaaaggtgccaagggccgcttcttggttttagcaaccacaaagactaatttgcgccccgaacgcatcattcagatgtacggcagacgctggcaaatcgaaggctacttcaaggttgctaaacaatatctgcgctttgatgcgacacaagtacgtggctatgacagtctttgcgcacttaaggcaatggtcatgatgagttatgatcttctcgccttgtgtcagcgtgaggaaactgacgaacgcacgctgggagacttgttcttctactttggaaaagctttacccgatatcggcattgcgcgagctttaagttggctcatggcacaattgattggtatagcgtcaacttatcatgaagctcaagcggtcattaatcagatcatgagtgaattcatgcaaaaactgccgaagagtcttgcggatctcttcggcagcgcggcatagataggatttgaatatgattttgtggatacaccctgacgcagcggcagtcagagccatttttttactttcactctttagttattgaatttttcagcagtctcgcttctttctgggctactattatcagtctgattttttatcttttctttttcaaaagagcacaagcgctattaaatgaccaagttattagtactagctgcccaattatactcgtgaaaaatgtttgtatagtcataggatcgttacagttttgtatagcaatatacgcattaacatctacagcaagcataattgttaaccaagttacagataagcagtaaataaaaaataataaatattcatgtatgtttatgctgcgcttatttttcctatctgtataccagacaaaaagagctagaagaaaggccaccacaataccgagaataaaaatccaaaaaaataatttcaaccgctcatctcctgaaaattaatttgttaaaaggtatcctaatacaaagagcgacattttggaagtgccatggtgatttatttgctaagtaatgaattaaggttaaaagttcttaagaaaacctcaaaaaccacctgcgcccttgaaattctctaaaagtttataacttggattgaactataagtgcactaactttggaccaatgctaactgagggcgttggtcttttttatgctcggtgtaactttgtcgtaagcgtctaatagtacagtacctacaaacattgagatcctccttctatacttgttctatcaagcagattggaggattttttatttctcaaactaacgacatggttcccgttaggatgattaaccgcgatagtgcttctgctgtcgtcaaacctaaactaggagctaaagtaaaactggatgacgccgaggtacttttctacaatggtgccgacaaagtaatggcgcgcattattttacaggagctgatgaagcatgattccagatctgtccaaggctaacatttacatcatttgtggccgcaccgacttgcgcaaaggcattgatggtttggcggccttagtgacagaggaataccagatggatgttttcgataatgccctgttcatcttctgtggcacccgtaaagataggttcaaggcgctgtactggaccaaaagtggctttcacttctgtataaacgctttgaaaactgctatatgcaatggccgcgcgatcgcagtgaaattcgccgcctaaattatcgccaaatgtcacgcttggtcagtggtttagccattgaagaacgacgcaccattcaagccataacgcccgggcatgtgtactgatactgcgaaaaggaagccttttctagaaatcaaagaaaaggcttccttttcgtatggccgcttgatatactcatttcaacaattttaacggaggatccaaaatgcctgctgaagcagcagttacgcaagcctaattcaactacctcaaacaagaaaatgaactgcttcgtgaacaagtggcatttctgatgcgtcgcctttacggtgcgaagcgtgaaagtctgaccgatggtcagctggatctttttgagaagaataaagctttctccgcaccagagccgacggaaccagaagcagctggcaagaagccagctgagcggaaaaaaagaaaaggcaggaaggcagcacaactggcgaattttcctgaagtgtctgtgcatcatgaattaactgacgccgagcgtcagtgtccaaattgtaccgccgaaatgcgtgagataggtgtcactgttaccagtcgtgaaccagttcgtattccggcacatgttgaagtccacgtgcattatcaacacgcctatgaatgtcgccaatgttcagaccaactagatcatagcgtcatcaaaaaaacccccttaccacagccgttcattaccaatagttttgcctcacccagcgtccttactcagacgatgatcgaaaagtttcgtaaaaaggtccccgtctatcgccaagagaaggattgggaagaggttggtcttcccctaacgcgtcaacaaataaccaactggcatatcttggcatgcgattatggtttggccgatctttatgaactaatgcatcaagaactgctcaaacagacaatcgttcacgctgatgaaaccagctatcgcgtcttagaaagtgaaaaggtgaagacctactactgggtattcgcatctgggcactgtgaggataagccaatggtcctttatgaacacgccgattctcgtgcgactgaggttccgaaacactttttaactggttataggcattatcttcaaaccgatggttatcaagtgtacgagaaactcgatcaagtcacgcgggttggctgtctggcccacattcgccgcaagttctttgaggccatgggcaaacagagcaccacgaaaagtgctgctaaaacgggggttgattattgcgggcgcatgttcacgatggaacgcaaatggcggctgctcacaccagaacaacgttatgaaaagcggcaaggccaactcaagaccgaaatgactaagttctttacttggtgtgagaacatccataccttaccgcaatccaaattaggccgcgcgattgagtatgcactcagtcaacgcgaagccctagaaaacgtcttgttggatggccgtctggagatctcaaataaccgtgttgaacacgccgtcaaagaactggttatcggccgtaaaaaccggctgttttccacgagtttcaaaggtgctcactcaaacgggattattttgagtatcatgcgttcagtcgaggccaacggacttgattgccgcaagtatcttgaatacttatcacaaccttcccgttccttgtgatgccggggcattacaagattatttaccatggtcgcccaaggttaaagccaactgttcgcgttaaagctgatttaaaaaaacggcttcggtattccttacagcataaaggatatcgaagccgttttaaatgtaccttacaatcgtacgcttacggtcattaatcagatcatgagtgaattcatgcaaaaactgccgaagagtcttgcggacctcttcggcagcgtggcatagataggatttgaatatgattttgtggatacactctgatgcagcggcaatcagagccatttttgcactttcactctatagtttagatattaattttaagtctttacacgaattccagtgtttttgtgctttttaagcataattttgctgatgacatcaacaacgtaataaatatcccacattgaaaccaagaatattgaggcccaagcaactaagataagagcgtttattaatttcatttctaatgaaggaatgaaatcaaaggatactgttataactataaaaataatatcttctataaatatcgtcctgattttttttatcaacgaatcaaaaaagtcttgagcttttgaaactttatcggcttctttaaaaaattctgaagaatgtcgttctccaatcagtagtccaataaagattcccgctgttgccaatattattgatgaaatagcaatcatatcactagatccagcccgaatactttttaattttccataatagtaaaaagtgctgaagaaggctgaaacaaccactgctatcaaccaccgtaaaatattaaccttgtctgtgagatcaccaaatttaaaaacctcttgcacttttgaaataaacttttttaagttcaaagttttcaacatttaggatcacctcttcagagattatctggtttgggaatagctcgagcagctctttgtctgaatcctttatttttgctgtttttatctagattatcttgaggcaaatcaaaattttgttcaacgaaattgttataaatgaactcggctcctggcgtttctcgattaggaaactcaatggtcatgcttgactttaagcgcggagaaagcagatctattgtctctatggcgtggtgttcatcttctttagaagcaatttgcatcgacacatcttttccttgttttgcaagatatttaatatcttcaatgacctgagtcacctgatctttttctaaagatctagctctaggtgttctactcattgaaactgttaaatcaaaagaaattccgccaatttctccagctgcatccacagctttatgcataacttctgctgacatatgttcatcattaagcaacgaaacatcacttgctttaatattaatacgtcgaataatttggttttgcaatgcgcgatgatatgcagattcatcaggaatcggcttcaatgaaacaactccgacttcattttccccctcgccaatactttctttgtatctttgtctaagttctgttaaagcgagttcgctttgcttcgtcgttaaaccataaaaattcgactgaaccaccagcaccccgctttcaggatcaaaaacgaaaatagaaaactcaccgacaaattcatccttgtctaattcaataggctttccgggcttattaagatgtttaagcgaagggatgttgttatatctgtttttggagattcgaaaccagtacaagtttctttgttgatcaagctgttgatcctcccattcaaagtctgccacttcatctcctaaaatgactgaactttcaatcttgcccttgtgatttagaagaaattcaaggaaatccttcatgttccatctaaagttattaccgttttcataattcaattccggaacaaagtagttgaacctcacatgttgtttcgtcataagcacatctcctaaatagtggctggtgatttaggttgcggtttctggccgaatttcagtcactttatagttgatttgataatgcaggccaccctgttcgaccacaatagaaattggtacagaaaaaagcttaaggaggaggtcgatatttgccaatgcaatcgcgctatccaccgttaccaccaaggactcagccgttctggtgttcactaagtcaagcccaagtgaacctttcaagaaggcaaacttgcgctcaatggcaccccgacgattttccgcactgacatcggctttgcgctgtttcggatccacatgtttgggctttcgacccagctttggcccattaagtttaatgcctagcttcttacacagattgatgttatctcgcgtgcgatagagagtatcgaccagcacctcatccggatattcacccactaggtcaaaagcatggtcaagcgttacttcaagatcagtgctttcgttaaatgaattgaagtcgaaacgctctacatcaatcacgccatccaacatggaacagtcaatcttggcgccaaactcaacggactgctttgccttacctcgcacgattggccggatatacggctgttgaaggctaacgatgcgattctcgacatggtgagtgtggttctcaaacatgaagagctgctgctcatagacttgtttaatcacttccagacgctgtgcttgccaatcagtgagctgaccgccttgcgcaagcagttccgccacatatcgcagatctcttcggatgtattgtagctgagcttgaagctgtttgcggcgttccttgttttgacgccgcggtttcctcgaaaaagcggtccacttaccttttgcttcacgtctgtatgtccgcggaatttccacacctaacccgtgggccagatctgtgaccatttgttcgagattcaaacgactctggttaagcagcgttgtatcttggggatacttgatcttgaccggaacggcagtcgcatcactaatcaaaacatgcgtcccctcaggtagatcggcctccaaccgctcgcgcgtgaagtcattagtaatgttgcggatcaaatctgagatggctgaaagccgttggcgaaagtgcaccaacgttgtgtgttcaaatggcttcttagcgcgatattcgggtaatccgatgaagtactgataggctggtgtatcacggatatcgtcgacaacttggcggtcggtcaggcctttcttcaacttgatcaacgttgcgccataaagcaatcgaaatggcttcgctgctcggccggtttttgaagggaactgtaattggtatgcctcttcaagtttggcccatgggatcaattctgcatattgaacccactcgttgtccgggctgagcggtgttcccagagcgcttccaaaggattcaagtgacagttgcgttgctttttgacgataaaccatgatcaattcctccgataggtcagcgataagtgcaagggtaaatcccaaagcataggcatttcgggcaaatgaggcttgcacttattatacgcttaactattggtaaagcctattatgaaaacacttttagagtttttcaccattcactaaatattgtttgtggccttagtatagcaaaaatggggatggttgagttcttcactgacaaacaatatcttgcgtagcaacattatatgcgaacatacgtttgaaagtcaaccgatacaatgtgctttatcaacatcaagatctgctttgcgttcaatcgattgcaaacgctctttcatgtataccataattatgcttgaattttagggctttttaggtttttgctgcattagccacaattttgtgtggctaataaccagcaactcctgcagtctctgtggcattgcctccgttggtaagataggcctcagtgaaggctttctgccacttgcttagtttcattacatatcaccacacctcccaaggcaaaataaaagacgccacggcgtcaatgttcaaaatttagtcttcggaattttgaaaaaatttctttacaataggcatgccccttactattatcagctctacaagcataacaacgaaaacagtaaccataaccttagcagcaacagataaggtttccaataaattaacaaataaattagttgaactcgttacatcccaaagagtttgaactatttctattgaaagtaccgtgttcagccaaagaatacggactattctccgatgatccttacttatagttggttttgctaaatcatttccaaaatattcaaaaacatcttcggaaatgagcaaaactgttaatgacgaaacaagcgccaatctgccgtctgaattaatccgatacaataatccaaccaatgcaatggtaatcagttcaagacaaaaccctatgataatctgtccccacgtcatttttggaaggagcagtttttggaatttcttaaacgaccttttggacatacttaaccacctcaccaaaatgatacgcaatatcatcgtaaaatactagtgaggtgatgcatggatttgccgttcgtatccactcaaggataagcgacaatgtgcctggcgggacttgcacccgctgaatctctgctgtcagccaccagctgctcacccattgtcagctagggttcatcgcaaagctgtttcgttacaagttcaaacaaggaaggaggactcacctctctttcttttatttttgtccggtcggattgggcaatgactactatgcctatgggaatatagcagccttcctagatcatgctaacccacgaaatctgctacttaacagtcacgctagaatttcctctaaaagatgcgctcattgcttatcaattcttgcacgaaaccatgatgaggtacaaatcacgatgattttgggctcgcttgggttcaaattgacggtatttcaggcatatcagtgatggtaggtgatttgccatctgttagcggcctaccagctattcttgcctgccagagatattttttcagcaagttacgcgcatcatcacggcacgcatgctcgtctatttccggaatcaatgtcatcaactgcgccactcctaatgatatacctgatttttgagatcaagtagggcgttccacatgtcggtgcgctatttttttgacttcttgaatgtgtacacctccgatgcacctccaatacaatgaattcatatgagtgcggaataatttcgggtaaagaaaaaagctgaagcatcaacgattttcatcattgaacttcagctgaattcatttgaattttataccggtcattcatattctattgttgccggtggtttactcgtcacgtcgtaaagcacccgattaacatgcttcacttcattaacaatccgactcgagatttcctgtagaacagcccagtcaatacgagcaaagtcagcggtcatcccatcaatactggtgacagcgcgaatagctattgcgtagtcgtatgtgcgaccatcgcccataacaccaacagatcgaatccctggcaacaccgtaaagtattgccaaatatccttatccaacccgtgcttagcgatttcttcccgcaagatatagtcggagtcacgtacaatctccagtttatcttcggtcacttcgccgataacgcggatgccgaggcccgggcctgggaatggttggcgccagacgagtgaatgtggcatacccagtttttcgccgagttcgcggacttcatctttgaagagtttgttcaggggttcgattagtttgaacttgagatcttcaggtaggccgccgacgttatggtgggacttgattgtttgggcggtgtcggttccggattcaaccacatcggtgtatagcgtaccttgggcgaggaattcgatgccgttgagtttggcagcttcttcgttgaatacctcgatgaagtcccggccgatgattttccgtttcttttctgggtcagtgacgccttttaggtcattgaggaagcggtctttggcattaactttgataatgttgaggccgaatttacctttgaggctgtccatgacttgttctgcctcgccttttcgcaacaggccatgatcaacaaagatgctggttagctgggtgccgattgctttgtgtagcaaaacgccgacaacggaagagtcaaccccgccggagaggccaagaaggacgcgcttgtcaccgacttcggcccggattttggcaatttgtttggtgatgaagtcgtccatgctccagttggcttcggcgtggcagacgtcgaaggcaaaatggtgcagaatttcgtggccgtattgagtgttttgcacttcggcgtggaactgaatgccgtagaatttacggtcatcgtcgtccatcgcactgattgggcagttgacgctggtggccgtggtgcggaagccatccggaacgcgggtgactaaatcgccgtggctcatccagacagtctggtcttttggcagatcgtggaagagtttggcgctggcatcggtgacttcgatgtcggccttgccgtattcgcggttgtccgccggttcgacatcaccgccgagtcgttgggccatcagctgcatcccataacacacgcctagaatcggaatgccaagtttgaaaatgtcctcatcaaccccgagcgcaccttcgtcatagacactgttcggaccaccagagaaaataattcccttaggcacgattttcttgacttcagccgctgtgatggtatgaggctttaattcagagtagataccaaattcccggatacgccgggtgattaactgattatactgactaccataatcgaggacgatgatcttgtcgtaatccttgttctggtcatttgccacagtccgccacactcccttgtttgaatgcactaattttacagagttttcataagctggtcaatcatgggtgagaagcctctcatctgagtaaaactgccaagtgacagtctcaccagactaactgatttcaggctttcacacatgtacccctcagtttctgaaaaccaaccaaggctctattttaccattttctcaacgaaacctggtcaattttatgtccttttgttttatgcaaaatgacgtcggcccgattctttgtgggcaagatgtattccttgaggttcttgaggttgacatcatgccagacctgccgcgccatggcaaatgcgtcagcccgattgccaatggcgtattgatagtagtaattgcttggatccgtgaaggccgtgtccagcagaatcccgaaccgttccaggtaccactgctcaattaacaccggatccgcgtcaacataaatggaaaagtcgaaatagtcactgacataaatcggttgcttgcttggcagctgcaagacgttaatcccttccacaatcaggatatccggccggtcaatgacttcatattcatttggaacaatatcataaatctgatggctatattttggtgcccgaaccaccccgctcgcatttttgacgttgttcataaaatgaatgagcagttccatgtcatagctttccggaaaacccttgcgatccagaatcccgcggcgttcaagttctgcgttgggatataaaaagccatccgtggtaatttgttgaacccgtttatccggataagcccggctcaacagcaattgcagcagtcgcgcggtggtgcttttcccgactgccaccgaaccggcaatgccgatgataaacggtgtgtgcggattgcgctgcatgcccagaaaacggctcagggtaaacatatcgccttggtagtcttcataacgaatgtgaatcaagtggcgtaatggtgaatagatggttttgacatcatcgaggctgatttcatcattcagcgaccgtaattgcgccaactcggcatcggtcacgctggtaaaattttgcgaatgaaactgtgaccattctgcccgatcaaacttgtagaaattcatttcggattgcataacttaccgtgtccttgcgtttaatgttcttattttagcatagaaacgcgtccatgtttggctaaccgcgaaaacgcgttcatccgatgaaaaggcatgtgcaaaggcccttgatcgcaatggcaaacgctgccgatcacgcccaaaaatattgacacaccgtttcctagtgggcttcgtttgtgatcgccgcaactgcgctttccttacgtttttcttaactgccgtttatcttgacagtttcaaaataattgttcacaatcaaaccaacgaagcgctgtcacgaacttagcaagccggttggaggtgctgcccatgattgagttcttgctggaacttttctccgatgttattttggagtttttactggcccccatctttatgccagaatttgatttgaccgcatcgccgaaatttaacggttttcgcatgatgctcacttcgcttattgatggtgggattaccgcagctggggcttggttattgattgaaagcctcaccgcggacccgatttcaatcatgatcgtctttgttgcggctgtgctcttgctggccgggctcttcatgtggtaccgggttagcatcagatttttcaactatcgccgcgcgttagttaaagaacgggcggaaaagatagcggccgaaaaaccgtatcaagaactttaaggttgtcccccgctacaaggtccattttcaaaaggaggtgaacggcttcatgcgtcagatcctgagctttctcggttcgattttgatcgccatttttcttgttcccacctttcgccgcaatccccgtccattttggtattggacgtggtacatactgcttgtcattttctgtgttagtgtcacagcctttgcattgtggttgctgattcttacccagctacgggccacaaaggggactattatgttggtcagtctgttactggttgtccttatgcctgtgtttttgatccgggcaacattacggtttcgtgattatcgtaagcgggccaagcaataattggcacacaaaaagcgctctggcatgagcgctttttagatactttcattaatcctgtaacttaaaggccagtttcatattcggagctgcggcggcaaccatttgccccagcagtgcattgctgttggtcatggctaagtcggccattttctcgttggcagcggttaagtgtgcctgaatgtctttggcatcctgcactgctttatccgtttcaagttgcagatgacggcaagcagccacagtcttttgctcaaacgcatcttcttgatctttgaacaatgaaaagtcgtagtcgccaaacgttgccagcagattactgagccaatacattttggtgacatcgaacttatcgccggtgtcgcggtatgctgccggtgtatcggtaacgttagcataaaacggaaccactgtgttgaaggtgttcgggccaaatgccaaccagtgaacacccgcaattgcagcaggcacatcgttacgaatttgcaaaatgtggagttcctgattacggttgatcccgatcggccggtacagctttttctgcgccggcgtgcccagcgaaccgtaaacatcgtacggcgtgttttcgtagtgggaactttcgacaaacttcacgtcttcgatactgatctttttgttagtgcggcagataaatggaagatcctgatcgattggcgtggtgtcgaattccggattgaaatacttttggccgtaccatgctcgcgggttgttgtaacgggtgtctttgatggtagccgagccgaagatatggcgcaagttgtagccttctgggtctgggttgaggtgataggtctcaatcagatcacgcaggtcggcgctgctcattgtatcatcgctggcaaaatcaaaattggtgatgttgaagcgattcggcgcaaccacataagcatcatcaggaatgcggatcgctgcccagtgatggccgccgatgctttcgaagtaccagacttcatctttgtcggcaaaggcaattccgttactttcataggtgccgtactgttggagcagactgcctagacgttgcaccccttcacgcgcactgtgaatatatggcagcacgatggtcggcatgtcttcttctccgatgccttcagccacaagcggatcaacgccgagcacccggctattggtcgtaattgtctcggttgaggtcatcgcaacgttttcgctattaatccctgcagccgcccaaataccgtggccatcttcagcttcaggcgtggacgtataccctaatggatcggccggcagatcaatggaaaatttgctcaaaacagactggtaatgacgcggctgatcctcaggtttaacgtacacaaacttttgcggatgtaacggtgattcgccatcctcgttccgggcaatgatcgtggaaccatcgatggaagccttcttaccgaccaacactgtggtacaggagccgacataacgttttgccaaaataatcgtccttctttcaaaatgaatccgcatatgtgcagaaccgtgcgggagtggatttatgattaactttaccgcgtgaaaacaggtttgccaaggggatgcgaaaacaagcgcaaaaaatagccatccctatcgtttgacagacttaggatggctatttgccacttctgagccgctgttgcttcaaaaattttaacatgcggtttaaccatgcgtctagccaaactaactcagaatccagctcattcagagtttataataaccagcaatttgctttgcggttattaaccgttaaaaagaaagcataacagttgaaatgtatggaaccgcgaacacttgtttgctacaatcaaattggcaacgtcaagagatggcggctactctcagaagaagggggtgatgcagatggttttcttccctgaagctcacaacccactgaagaaaggagcctaggtttgtcggtcttcgaagccctgagtctggtcaatcaagtcgtggataatttcctgacgctgattgtgctagtcacagtgttaacagccgaaaacaagcgcaaaaaatagccatccctaaagtttgacagcctcgggatggctatttgtaatctcagagccgctgttaatggcgttgtcgtttcagagaggctagcggttggaaaccgctagcctctttgcatgattattttagcatgcagtctaatgatgcgtctagtcaaattactctaggcttgctaattacccgaaatcgaagaatacaaaagccacacttttttcgcacaaaggcgaaaacagcgcgcctttaggtttgtggctagagcttctagttatatgcttatacgctaacactgtagcaaacacatttctccatgtctgctcaatcttttgatcaacatacctgcgcttagcaactttcaatccagtggcacttcaccaaagctggcgttaatcttccgataatccgctcgccgttcagcgtaacccgcgagcagccgcttttcaaagtccgattcggcttcgactggtggcagtggaccgtcttccttgtggcgggtcacaaaagttgcaaaggccgttcccacttgaaaacgctcgccgctagctaagtgctcgccgataagttgggcgaagacttcaagtgagcgatgaccaacgccgctgaccatacacttgataattaaggcatcccccattttaaccggtgcggccaagcgaaccatatccagcgatccggtggctaatccgcgccgacctaatcgttgcgcggcaatggagctgacgtcatcgatccaggtgaagatctgaccgccaaacagcgtctgatgggcgtttagcatccctggaaagatgcgataactggaaactgctaatgtatcccgcattttaaccattcactcacccccgctcgtacaattcttctggcaccttgtccaacaacggtgtcacgtctggactagctagcatcgtcaaccgatgcatggcccgcgatgcaacggtataaagcaattcgcgttcgtcttcttcatggtagttttttgcgttaacctgccacagcaccacggcgtcgaattccaatcctttggctaaaaagcttggtacgacaatgacgcccgccgccaagcgttgattttcggacttgatgagggtgactttaatgccggcagccttcatctttgcgtaaatcgcttctgcagcttccagcgttttggcaatcaccgcggtggtttgtttggcctcgtcattcaccttcagctgagcttgcagtgcggtcatcaaacctgcttcatcaggccggacaatcagctttggcaatggaccttggcgattaaaggcaacgattttctgtccggatgtcaaaatggccttggtgaaatccgtcacctgtttcgttgaccgataactttgcgtcaactgcaccacacgggttttctccggatcgaataacttgctggtctcattaatcagcgtccgcgagtcatcctttgtgaaaattgcctgattcaagtcgccaagtaacgtaaatttcgcacgggggaaactggctttaagataagccaactgatatggcgtgtaatcttgaatctcatcaacaaagacatagcgcatttcgcgttctccgtgccggccggtaatcaaatcatataggtgcaaatatggcgttgcgtcagccatgggcagtttgcgttccttgaacatggcaataaagtgatccacttctgcttgccagtcagcttcggaaatcccttccgctgctaagtcgtaaatggcaggcacttcgcgtaagaagctgacatattgcccccggatgttgatgaaccggttgcggacaatatcttgctgaatcgcgtcaaaacctttcatgaccaactgccgggcaaagaagcgatattcatcgtcactattcttaaattcttttggcccatcttgttgcatggagcgaatttcttcatcgcttagattctgaactgcttcttgaacccactgtgctttggtctcggattcaattttgcgattcaacattttaatcagccgctctttagtcgcattcaggcggttgcccatatgataattttcgttatagctgtagaagatctcccgaatccgcttgcgtgaaaagaaaacttcgccgcggaaccggatatccctaaaccgcaatccggagcgttccagactcgttgcataggtctgggcagttttaaagaagtccaaacttcccttgacccgggcaattttcttttgcaccggcgtcaattgctgttcaaactgggaaaagaggttctgaacctcaatatgtggcaggcgccgggtgacatattgataatacgtaaattggaccatgttttgttcgcctaattccggcaacacattactgatatagtcggagaaaagttggttggggctaaacatgatcacttggctgctcgtcagattaccgcgataacgataaagtaagtacgcaacccgctgcaacacggcactggttttcccggagccggctgccccttggacgaacaacaaatccgctttggtatcgcgaatgatctggttctgctcacgttgaatcgtcgtgacgatggtcttcatctgggtgtcagatttttcgcccagaacttccagcaacatttgatcgccaatggtttcggtggtgtcaaacatggtctgaatctgaccgtttttaatcacaaattgccgttttaaggagaccgtgacttgttgcgggccatcaggggtttgataagtcaccttacctaagccgccatcataataaatcgaactaatcggtgcccgccagtcatagatgagaaacttgccagcctcattcgtaaacgaaccgaggccaatataaatcgtctccggcttttcgcgaccttcctgaaaatcaatccgggcaaaataagggttccccaacagccgctgcaccgttgccagctgctgtgcgctttgcttccaagcattcgtccgctcatcaagcacccgctgctgttgctggatcgaagcagctgtttcaatggtttcagcataattcgtgaagtttaaagaaaaatcgttgaaaaagttatcactgatattcttctcttcggtcttggtcttggccatctctttagaaagccgctccttggcacccgaaagctccttcatgatcgcatccaaatgctgctgctctttagcttgttcattcccagccacgacgtcatctcctttaacggttattaaataatcgttataacatcttatcacttatgaggaaacgccgcaaaaaagagtgtgagcgcgaaccggcgcggttagaagtcggagtgtaagtggcctcaggcgtgatggccgggctttggcccttgcgactgaggtccttacacgcagacttctgcgccggtgagcgcgttatgggcgtaagctagaacaaaagcggcctcagacgtgatggccggactttgcccactgccaccaaggtccttacacgcagattcctgcgccggtgagcgcgttatgggcgtaaaccagaactcaagcgaccttaaacgtgatggccggactttgcccattgccaccaagatccttacacgcagatccctgcgccggtgagcgcgctatgagcataagccatgccccctacttcaacctcccgcgcaacaacggcgtccaagcctccaacacatacccaaccgccaatccaaccgccacccctaacagaatctttttaaacggcaaactaaccaacaacccgattaacacacaagtaccaacgataactgcacgccgattgaaaaacgatttaccttgacgtgaaggtttttgattttgtatcatacgcttccctttcatttataaatacttttcgttacgattgactcatccattatctctgatcggaggccattatggaatctatttcacttttaatcgtcttgacagccgcgttgttgacgccgctgttaatggcacactttcatattaatagtatcccgactgctgttgccgagattctagtgggcatcatcttaggcaaaagtctcttaggttgggtccatactggcggcgaaatgcaggcgttaagtgaactcggtgtcaccatcctgatcttcctgtccggcatggaaatcgacttttcgcttttcaaaccacagcccaagtcggacaaaggacctcagccggccaatccagttgtgctagccacagttggatttgcaacggtcatcatcatcagtttgggattcagttacctgctcaaattcattcacttctataacttcccgatttttgcaaccattctgttcaccacgattgcgcttggcgttgtcattgcggctttaaaagaacaggagttgttacatcaaccacttgggcaaacgatcctgctgattgcggctttgggtgaagtgattccccttatcagtttaacgatttactcagccttgaacggttcaagcgataacaatctatggttactgctgttactcctgctggcggcgttggttttactagcgcgattcaaacgcatttacagcttttttgcggcgattgataaaagcaccacgcaactagacattcggttggctttcttcttagtcttcaccttagtgaccatcgcttcacgagtaggtgccgagtccattttaggtgcctttcttgccggcatggtgatgaagctccttggtccgcgtcaagagactcaggataaattgacttccttaggttatggcttctttattccaattttcttcatcgtcactggggcaaacctcgatttgaaagctttagtcgctgatcctaagagcctctccttgattccgttggtgctcatcggctttttcatcaccaaaatcggcctcattcctgttttgcggcagcggtttaagccgcaaaacgcattggcgggcacgtttttagccaccaccaccatcaccttggtcattccgacgttaaccgttgggtgcaaccttggtatcgtgaccgagcagcaatccggcgcgttcacactggcagcggtcattgcctgtgtggcggggccaatccttttcaatagtttcttcaagcctgaaccagaaaccttcaaaaagacccgcgtcacctttattggcggcaatcttttgacggtacccatcgcgcaacatttaagtcctgagcgctatgaggtgcaactatttaccgatcgggtagaaaattttcggacgtataactccgaagtggcgatcacattaaccgattatcaggaggacgcgttaaaagctgccggcgcatatgattgtgatgtcatggtgctgggtgatttcgatgcggacaccaattacggcttggcaaaaatggcattagcacagaaagttccacgaatcatcgcccggtttgccgcaaaagacgctacctctgatcgctatgaccgattgcgcgatgatggcgttgaagttttcaatgcactcgatgccaacgttgcgttgctgcgtagcttgatcgaaaccccatccacgttgagaatccttgatgatacaattgcaggcatctatgaagttaccattcgcaattcgcgttttgccggccttgagctcaagaatttaccgttcattgatgacatcaccgtgagccagatttatcggcaaaagaaattcattgctcctcacggcgacacccaactgcatcttggtgaccacctcattttctccggggacaagcacctcatccgcaatatccgctcacaggttgaaaagttaaattaatgctgctcaatcaggatgtgaaattctgctttgatactcgccaatgaccgatctcagtgcaaaatagttataaatggcagcacttccttttttacgccgttgtcaggctattttccgtggtacaatgagattattctaagaaaaaaggtgatcaaatgaaacaaggaacaacgatcctgaccttagacaatggctaccacttgtggaccaatacgcaaggcgaaggtgacattcacctgctttgcctacacggtggccccggtggcacgcacgaatactgggagaactttggcgaagaactcgctgatctcggcgttcaagtccatatgtacgatcaactcgggtcgttttactcggatcagcccgattattctgatccggaaattgctaaaaaatatctgacaaccgattactttctcggtgaagttgaagaagtccgcaagaagctaggattggatcacttttatttgatcggccaaagctggggcggtgccttgacccaactatatgcgttgaaatacggccagcatctcaaaggcgcgatcatttcatcaatggtggacaacatcaatgagtatgttgagcatatcaacctggtccgcgaagaagcattgcctccttcagccgtaaaatatatgaagaaaatcgaaaaagctggcgattgggacgatccgcaatatcaaaaatatgtggatgtcttaaatcgcggctatgtcgatcgcaaacagccaccggcaatttcacatctaattagcacgatggcaacgccggtttacaatgcgttccaaggcgataatgaatttgtcgtcaccggtaagctgaaggactgggacattagcgatcaaattcacaacatcaaagtgccgacactgttgacattcggcgaacacgaaaccatgccgctaaaagctgcccagcgcatggctgaagtaattccgcatgctcggttggtaacgactccaaatggcggccatcatcacatgattgacaacgcaccggtttacttcaagcatttgaagcaattcatttccgatgttgaaaacggcacctttaacgactaatggtaaaaaccgcgcccttactgttaatatggtcgcggtttttgtctatgcatctttttaacatgaaaggatctcaccatggcttacaccgttgattttaaaaccgttagcaccaacggcttagaaagttctcctgttgcaccggctttggctgggctaagagccaatgaagcccggtatatttggaacaaatataaagttccttatgtcacctatcctgtcagtgaaaaaccggacagcctcgcttgggtgcaggcaatgcttgcagaacgccagctccatatcgctgccaagccgcttgaaatctgtgaccttgcgctaccggatctgcgctgggttgaagtctattatcaagatggactagctatcaatgtgatgtatcaccttactgatccccaaaaacgggcagtcggctttaaactcagcgacggcatgaccgttcccgccgaactcgcggataaatttaaatttgcccgccaaaaatcaaaactcgccggcaccattcgcggatccttcttcgtaattaaaggaagttactgatcgcaacatctatcacgtaccagatcaggttcaccaacaaaacggtcgatgcataactgcgcatcgaccgttttatagtattcaaggtaaaataactgacaaaataagttgcacattcaacaacgtaatgatgccggttaaaacatatcccatccaacgcacgactggagaattaacgtgctggcccattaagtcacgccgatcggttaatgccactagcggaaatagcgtaaatggcagcgcaatgctcagtgctacttgcgcgtaaacaataacctgctcaaagtgttgctcgctaaaacccatcacaaagccaatgatcatgatcggaatcagcgtaaccaaccgcgtcaataaacgtctggcccacaacggaatctgaatgttcaaatagccttccatcacaatctgaccagctaaggtactagcaatcgaactgattaaacccgtgatcaataacgcaaaggcaaacaaggtgctcattaagggactggccagaccacccacgattgccggatttttcaagccgttataaacaccttcaaatgcggtggcgtggctgctcatgccataaaataaagttgcccccagaatcagcaacagcgcattaattataaatgccgcgactaaatggacattagaatcccatttgccaaagcgcagcgcctcggtgacctgcgcgggaatatgttcatcatatcggcggctttgggccagcgatgagtgcaagtagatattatgtggcataatggtcgcacccataatgcccaggcttaataacaacatgccacgattagtcagaatctcggtatgcggaaccaaccctgcaacaatgcctcccattgacggccgcgcccgcaccacttcaatgccgaaaataatgccaactgttagaatagatgccaacacaatcaactcgatccggcgaatgccaaaccgcaaaaacatcaacaccaccaacacatccgcgatcgttagcagcatcccccacatcaatggcaggccgaataatagcttcaacgcaatcgccgtaccgacaactccggtcatatccgttgccatcatggctgcttcgttcaccagccacaatccgattcgactccacttcggaacaaacgccgcaatcgcttgagccaaatccaaccgcgcgaccaccccgagtttaatggccaaggtttgcatgaacatcgccgccaaaattgacaatagcaacaccgctaataatgtctcatgatagcgactcccgccctccaacgccgtcagccaattgccgggatccatatacccaaccgcaaccaacgcaccgggaccactgtaggccaggaacttttgaacaaatgatggttcatacactcccggtacctgcacactgcgattaatctcatccaaactaggctttgcttgctggacgctgagctgctcatttcgcttggtcatgacgcatcacctctgcagcaaccttttctttcgccagcgttgctaaaaaggcacaaaacgcaggactgccattcatggggcggacagttttaaagactttaccgccattagcgcgaaaagtttgatagttttgaacatcattttcttctaacgtctccaaacaatccgtcacgaaactaggcgtcgtcaccaacacccgccttttgcccaacgctgctaaggccactaaacgattgcgtaaatacggctttaaccacggtaccggtccgaacttcgactgataacacgtctctacaatggccggtggtactttggtcagataacgcttaacccctgctgtagtcgcttcacaggcttgctgataaggatcgccatgccgcaccatcgcggttggaatgccatgataactcataatcacggcatcatagtcaccttgtatgtacgcatcgtccagttgttgcgctaataacttctgataagcggactgctcgtaaaagtgctcaacgttcaatgttttaacacccgatgctgcgactttttccaggattgtcttggtggtgctttgggtatacgccggaaaaaggggaatgacaacaatcggccgatccccgcgtgctgccattgcttgcaaggaggcggcaatgggatactgaccgccataagtcatcgccatttgaacatcccaatccggaagtgcctggcgcaagcgatcacgtgtgacttgcgtataagcaatcaacggtgagccagcctgcgtccactcgtgctgataaaatgtcgctgaccgccaactgcgaaatggtagcacaaatccacgtaaaatcggttgccataaaattttaggcatggtaatcacattctgatcgcttaaaaactcccgcaaataacgccggacatctttggtttgcggtgaaaccggcgatcccaaatttacaattaataacccctttgccatttaactgcccccattgtctccaaaaattataatttaagaataacacaggtccatcgctttaaatttgctttcttggagcgagtcgtttaaatcattccggttatcaactgccaaatcctacgctgacggcaaatctttttcgcgctttcgagacacaaaaacctcgccgcaccacaatattgggcacgcttcccgccaaccaactcctgcttctatgctaaactaacattagaaggataaaacgtttgccgaggtgaaatcggcgagcgtcagactgtcgaggaggcaaatttaatggctacgaaaggcattaccgtctacctagtgcgccatgggcagacatggtttaatcactttaataaaatgcagggttggagcgactcgccgttgactgaaaacgggatcaaggacggcaccaataccggagtcatcttgcgtaatgttgcctttacccacgcgtattgcagtgacactacccgggcaacccggacagcagacttgattttaagcaaaaatgtcacgggtaagattccgctgacagtgacgccgtttttccgggaacaattttacggctattttgaaggtgaagattcgggacaaacctggtacatggttgggttcccccacggtgcccgtacttatccggagattctcgaaaaatacggtgtcgatgcgtctaaagacttcatgcatgacgctgatccgtttcatgaagcagaagacgctcgaacttactggacgcggctaatgaaggggtttcggcagttgcgctcggagaatcatgaaggcgacaaagtactgatggtcagtcatggtacaacgattcgcagtattgttgacaagtttggcaaaaatgatggcttcgtagtaaccgactcaccgcgcaatggttcaatcagtaaaatattactgacggacacaggcattaaggtcttaagttataatgaattcgaagcctgattcaatttaaaccttcaagcggtgatttttcagccgctttttttgatgaaaccaaaagggtcacacaaccagctttgcatggttgtgtgaccctttttcagacattttattccctatctaggccactgcgactagtgaaccaattctttttcctcaatgagtgaaccgccgtggatgaactccggattcggggtcaaatcgaagcgttcggccagctgttccagattctcgtctgtgatttcgttgacaaactgaccaccttgcgcctgaattgcggtgtagatagtagcggctttttcaacggtttcaattaagccgtatgtttcgtcaatcgaatcgccagcaccgaagataccatgcagcggccacaaaacgatccggtattggcccattttttcggcagttgcctggccgatttcgttggttcctggcgtcatgtatggtaaaacgccaacgccttcagggaaaacaacgattgattctgcctgcatcttccagagaatgcggctgaacaatttttctttccacggtaacgtaaaggtcatagcaatggtgttcgttggatgacagtgcatcacaacccgctgattaggatcctgcttaagccgttggatatgggtcatcaaatgtgccgggaattcactggtcggctgaccgccatcggaaaagccccagagtaaatcgacactttgaccgtcttgattaatccgaaccagtcctgtatcacgttccgggaagtctttgacgttcttgaaatagcgaccggtcccggttaccaagaaatattgacctgccaaggcactggcatcaaacttaatcgggatcgtgcgcttgacttcatgaacatcaccgtactgatcgacttcctgctttgtaagtcgatagctgacattgccgccatttcgttcatcccaaccatgttgataaagattccacgtcaccttacgcatctgttgcacaaatggtgaatcaataaacgcctgtgtatattccggattcaagaaatctttttttgaatctgccatgaaaacgttccttctttcttctggtcatcatgccaaagctatccctttacagtgtcaaataaacagatcaacttttttgttgtcttaaaaagcgtcaaacctactgcacccgaatagccattagcatgtttgttatcaatctttcttacagcttctattttacgaagccatgtaagcgctcgaccagaccaaatgtacgcatcaaaacagcaaaatcggaacagatgcacatatcacccggtatcctggaaatgaaagctcaatccggttataacatgacgaatagcacttcacggttggcccgtcagtattttggcttttcataacgcactacacaaaaatcggctttagcgtgatggacaaaaccatcgctaaagccgattacgattcattttaacggttcaaattttttcagaccacactgccgggttgcttaagactttgaggccaggttcttattaatcacaatactctggtaaatccagacggttgccagatagtacaaaccgtacagcacgatgaataacgcgaacggtactaacaaatgaccatatggctcgcttaacagggtcttgaacaactgtaatccgaataacacgtgcacgatgccgaccactcctggcaagaggaacaaggcgccgatttcctggcgaatcgaccgacgtaaaacgcgcggccgggcaccaattttttgcaacatgagataacggttcttatcgtaattggcacccgatagaattttgaacatcaacgttgaagccaacatcgccaagaaagcaattcctaggaagaagcccatgaaagccaagccggaatacaggccattgaccaccgcatagaagacaaatttctgatcgccattgctgctccaaagccgtggatattggtgctgctgcagcgtcacaatcctttgaatcgtatcgtaattctgattgaagtctttaactttaatggttgtcaaggtctccggattccccaacttggcaaaagtggcagcatccgcaaccttcatctgcttgccgcgattgttcccgatgaagatgccaaaagcaccggggtacaattcgatcagcttttcaaagttctgactggtgactttgatgttgggtgcattgatgcctttatccaccgctttaatttccaacggatgggcgtcaagttccgtttgactgatgtagacggttttagcatctgatttaagttcgtattgctgtttggcggtcacatcctgcaacttattgatttctgcgcgggtggcggcatttggtgaagcaaccgtcacgtcgtaaactgtcgactgacttgccagcttgggaatgtcatgcgtaaagcccatccccacggtaatggcgcctaaagccagtgcaaacagcatggcaactacggataagatgcgggtatagtcccgaatccgaaaactgagctgggacaacgtgaacgtatgcaactgcttggctgcaaatgtccgattccgcttcattaaactgattaaagccacaaagacggaattaaataagaaatatgttcccaaaacaatggttaccaaagctagcggaatcgccattaactgaaacttaggaacattggccatgctgtaataaccgatagccagcaagatcacaccgaggacaatctgcaaggcaaagctgcttttgtgttgcttaatccgattcggtgtctgggcctgatgtaataactgcaacatcggcgttttcagcaattttgccgcgttatacatagcagacaaaagaaataggacgaagaagaaacctagtgtccataaaatggctggcacccagatcggtgaaaaacccgtggctggtgcatgtaaagcggcgataatccattttccaataaaaagtgtgccaaccatgccaataagaatcccgccaatcgtcgccataatcccgactgtgacggtttcaaggaaaatcagctggccgattttacgcccttttgcgcccagcatcatgaacatcgcataatcgcgttgacgcatactgagcaaaaagctgttggcgtacacaatataaactaacgtgataatcgccagcaaaactgccccgaacccgaaaataaacggggtgaagccgatgggtgaatttttctttaaaaagctcgtgttcgttgctaaagccataaacatgtagaaaacagcgctggcaatgaccagtccggagaataagaccgcatagtcgcggaaacggttttttaagccgccaagtgcgagtttacttaacattcttgctgcctcctacttctgaaatgtgccgagggtctcaagaatctcttgatagaaagcttcttgactcttgtcaccgtggacgagctcagaaccgatctgaccgtctttgatgaacaagatccgactggcatagctggcggaaaacggatcgtgggtcaccagcagaatcgacacaccttcgtcacgattcaaatgcgccatggtatccaacaattcgcgcgcagccttggaatcaagtgcgccggttggttcatcaccaaaaagaatatccggctgctgaaccaatgcccgagccgcggctacccgttgtttttgaccaccggaaagttcggttgggtaatgatccaacacgtgttcaatgccaagcgtttgcgcgatcttatcaacggcttcggtttgctttttagcgctgacattttgcaaggcaagtggcaatgcaatgttttcccggccggttaagttttctagtaagttgaaatcctggaaaataaagccgatctttttggcgcgaaaatcggataaggcgtctcctttgagtttggtcacatcggcgcctttgatgcgaacggaaccggatgtcggggtgtctagcgtgcttagaatattcaataaagtggttttaccggagcctgaagcacccataatcccaacgaattcaccgggttcaacctgaaaactcacaccttttagtgccggcgtttgtttttccccttgtttgccatatgttttcgtaacattttcaaccgttacaacaggttgcttgtccatgataaacctccatttgcaatgtgcttgctttttatttacaagattaatgataatggctgccagcaattttttcctgataatgcactaacggatgacggatcgaaactaacgggtttgtaagctactttagcttttctttatttttggcccccatctcgccgtaatccttgctataatcacacatgagctatgaaaatccttatgaaagttggttaatcgtgggaacctttcgcaacaaaacgcccgggctaagttcaaaatcagcggctgattgaacttagtaaaggagcacattttaatatgaatgatttagaaaaaccgcaaaagcagtacattccctggatgattgtcggcttgatggactttgtcaccgtcatcgggtttgacgacatcatctataacttccagaatcaaggcttggtggcattcaccagctggattatcatgaccttcttttatgtcattccgtataatctgattgtcgcacatatgggttcgaccttttccgaacacggtggcgggatcaccagctggatgcgcgaaaccaatggcgatacggttggttactatgcggcctggttttattggatcaccgggctgccttatgtcgtggatgtggccaattcggttgttatttcttttggctggatcaccaacggcaacggtaacattcaagccaaccttggtaatgcatggtttggtattctcacggccgttatctttgtgatctttatctggttacagcacttcttcaaaaataaaagtcttgagatcatgtcaacgatcggcggcggggccatgtttatcatgacggttttattcgtgatcatgaccttcatcgggttatccaaaggcgcaccgattgccacccgcccgtttgatttcaaggccttcatccccaaagatttcttttcactgagcttcctatcgacttttggcttgttcgtctttgccatgaacggctccgaacttgccgctccctacaccaaggacatgcgccatcctgcccgtgattttcccaaagcattgaaaatgattgcgatcatgaccatgttcctgacactttttggcaccttttcattaggggtttactttaacgcccaccatctgccaaacgatttgaaaatgaatggttcctactatgcgtttcaagccattggtcgtcaattcgggatgggcaacagtctgatgtatctgttcgccgtggtgcaaggtatttatatgttagcccagctggctgtgattctggacgcctcaacccgggtcttcctgtccgatgtggccaagcgcttcatgccgcgtcagttgacaaagatgaacgaagacggcttgccgattaatggttactggatgacaacgattctgtgtgcgttgatcatggcactcggcgcacttttgccgaaaatcaatgacatcttcaactggctgctcaatctcaacggcattgtcagcccgctgtccacttgcttcttgttctggtcctacacgatggtccggttacatcaggatcggttcccgacgcctgattatacgtttcttaaaaatcgaaaaatcggcttagttgtcggtatctggatgttagggattacctttttacttggcacccttggcttcttcccgactgacgccaccgcggacacttttgcactcatgctcggtttgaatatcgtggtgccaattggcatggtcacgcttggcgttttgatgccgtggatcgccaaacgtcagcggcaagcagataacggccttgcgtttagccgcaacacctggttggtactcactaccctcagcttagtcgggctagttgttgcagctacttatgggatgcacgtcaacttactcgatcacttaacgcctgtcattcaatggccactgattgtcatcgttgaccttgccattgccggggtggtgctcaaagtcaccgcaaacggccggcatcaacgggtggctggttcgcctgatgagggatgagttctggcttactatcttaagagataattttataaataaagattagctatatgatgtcccggcaacgaaacctgttgctagggcattttttggctgtaaccggattgtccagcagaaaaaatcaaccgccgccagcaactaccagtcagcgacaccgttaccacaccgcgtccatcgtagcaaaaagttggcacttactatgctggcagtaagttaagtagccaccgtgacaacgtgataaaattaattgtagaaattggttttttgcatagctgcttcgacttatttttaaacaatcgttgaagactcagaatattaggaggtgccgtatgctcagctacacgattatttataatcctgcttccggccacgctaaaggcccgactgccgccgaacagctcaaggccaaacttgaagatcgccagcggcaagtcaccatggcaccgactaaaagtgctgatgacgcccgaaattttgcttatcaagcccaatcggatattgtcgttgcagttggcggagatggcacgattaaccaagtcgttgccgggctcgcaccgcgcaaacaaccgccaacgctcgctattttaccggaaggcacggtcaataacctggctaaagtcctgcatattccgttactgctgccactggcgatcaagaacatcttagaagccaagccgcagccattagacattgcacaggtcaatgatcgttacatggtaagtaccttgacactcggtgttttagccaatgcggcgttgtccgtcactcaaaaagaaaaacgtcattttggtcccatcatctacttattaaagggttttaaagttttggcccaacaccaacactggatcctacacttgaacagtgctcacaaccactgggaaaaagacacccaatttctgctagtcagcatgaccaattccgttggcggttttacgaacgcggtgccagatgccgccgtggatgatggccatctacatgtttttatcgccccaaaactaacctggtggcgctcactactagccatcccctacttcatcaccggcaactttcagaaactacccggcatgacttatttcgccaccgagcaacttaccatcgaggctccaaaaacgctccaaagcagggttgacggcgacccgagcaccaagacgccgctaaaattgactgtcatcgctgaccatattcaagtattagccccaccggtgggaaaataatctgacagtgccgcatatgaatgacttattgcatttataacgtctacttttaagttgcgcagtttcaacggcttttgactgtcgtgctgctttttttactagcctgaacagtcctcgaatagtccgttagtgtaaaatttcgctcgataagacgatagggccggatgataaaaccatgaaaaatagaaagtaagagctggcggagcggtggcgggctcagtggtgaaattggtcttaagcggagtgggcttctccgctttagaccaaggccgagcttcgaaaccgcggtctttgcgggttcgaagtcgtgcccaccacgttccagcccagccaccgcggagccagctcggagtatcggaaatcacttaattagagtagaaccaagtaaagttgacacttacgaatagtccgttctaatagtctttccaaaattcccgtgttacactagacttattcaaatgagaggggtgaatcgccatgcggttacgcaaggttgcaccatgactgtcgattcgttagtaccgatctgtggcgataacgcccggatctatgaaaggaatttatgactgaacaaatatctaatgaagtaacttctgaaaatgttttaattgccggcatttcgcggcaacaacctgactttgactacaccatgaccgaactcggtgaattagccaaagcggataactacaccgttgtcggcgaagtgcggcagaatctcgatcgcgcagtggcggccacttattttggttccggcaaagtagacgacattcgccaactggctaatgtccgcgaggcttcaaccgtgattatcaacgatgaattatcgccttcacaattgcgcaatcttgaaaagcagaccaaactgcatgtgattgatcgcacgcagctgattctcgacattttcgccgaccgcgcgcgcagtaaagccgccaaaactcaggttgaaatcgcccaattgcaatatgccttgccgcggcttcatcccagcgccaaccgcctcgaccagcaagtcggtggcggcgccggatttgccacgcgtggtgccggtgaaacccaacttgaactcgatcgtcgggtgctcaacaagcgcatcagtcacttgcgacaggaactcaaagacgccagcgtcggcgatcaagtacgtcgcgcccgtcgcgaagacaaagccattccagttgttgcattagtcggctacacaaatgccggcaaaagcacgaccatgaacgggctgctgcagctgtttgcggatcgcccggaagacaaacaggttttcgaaaaagacatgttatttgccacgctcgataccagcgttcgccaaatcaccttgcctgacaatcgcaaattcctgctgagcgacacggtcggtttcgtctccaaactgccccacaacctcatcgacagcttcaaagccacccttgccgaagctgccaacgccgacttgctcattcaggtagttgattattccgatgagaattacccggaaatgatggccatcaccgaaaaaacgctccgtgaagtcggcatcaccaatatcccgatgatcgaagcttacaacaaagccgatttacgcgaaggcacccgttatccggaaataaacggccaacgcctcgtctactcggctcgtgacaaacgctcgctccaagccctcaccgatctcatcaaagccaatctcttcggccaagatgaagaacacacctacctgatcccatttgatcaaggtcagctcgtcaactacctcaatcaggaaactgtggtcaaaaccactgactacacggaacacggcacgcgcattacagccgttgttaacccggttcaaaaaggtaagttggcacggtttgcggtaaaagagaaagtttgacttaaaaccataattgacaccaatagggaccttgcttttcgctgcttaatcattgtaagcaggattggcacggtccctttttatagcgttaaaccgaatttggcgttgatcggctattatggtcactcaagaacaccaaatttatagccattatcacggtaataggcaataattttaggtaaggtttgaactgtcaagtctttacccagtgcgtcatgcatcagcaccacccgcacttgactcgtgggataaacggccaatgaccgtaaatgatattgcaacatggccgcttcggtttttggttcctgcgcctgactcaaagcatctccaaccgcagcattccaatcaatccaatccaaccccaaccgtgccaagcctttgtcggcatcagccagacccttccagctaaaatgaccgcctggatatcgccataaatgggtgacaaaatccggtcccagcgcctgcttaaccatcgtctgctccaacttagcctcatgctcgatcgcagccgtcgctccaactcgtcccggataaagcacattataattatgcgttatactatgtaagccaatgctattgcccccatcatatatcgccttcaaaaccggtacagtcgcaggcgaaagctgtcgcccaacgacaaagaaagtgccatgaaccccttcttgattgagaatgttcaaaacgcgtggcgaattgaccgtattcggcccatcatcaaaagtcagaaacacgactttttctttgatattgctcgtgttgggttcggtcatttcctgtttgacttgagcaacggggtaagcgtaagcactggctgtggcgaggtgactctgtccgcttggcattgacggtttctctgattctgcagttttttgttttgaccgtgctattgacgcccgctgcctttcaacaagacgtgaccttgaggcagcggccttaactcgtgccttcttcaggctagccaggtcgtcttggcgctgctgggtcgcaaccaactggcgaactactaacaagccgccaacaatgataagcgttgtcaggaacattatcaggaccatgaagtttttgctactgctatgttgccgcttctttcttcgcatcgtccaactccagtttattagtttaatccgagtgcaagtttatcatgatttgcgctgttacagttgttagacgacttgcgttttaagatcaactaaaaatccatctttagttcgcaccgaaacggcaagtaaagatggattagtaaaatctattcttcaacgctactcaacgcagcgcctaaaaattgcaaagactcgttcaacattgagtgcgaaacgattgcgggcgctctttcactcgtccaaactcatataaaattgcattcagaatccgctcagaagcgcgaccatcgccatatggattcttagcatctgccatgcgctgatattccgcatggtcatccaatagttgaagcatagccgttttcaccgtctgcggttcagtacctaccaacttcaacgtcccggcttgaaccccctccggccgttccgtcctgtcgcgcaagaccaaaaccggcttacccaatgaaggcgcctcttcctgaacaccaccagagtcagtcataataaaatagctccgcgcggctaaattatggaaatcgacaacatctaacgggtcaatcaagtgaattctggaatgatgatctaaaattgaatcagctgtctcttgaacaactggattcaaatgcacaggatagatcaactcaatatccgcatgggtctcaaccacttcgcgcatcacgcggaagactcgccgcattggctccccttgattttcccggcgatgcatggtgacaagaatcattttttgtttggatcaatcagatcaagcacttgatgatgataatctgtctgaacagtttgatcaagtgcgtcaatcgctgtattgccagtcacgaaaatctgctcttcaggatgatgctcggccagaagattggcctgactctgttcagttggggcaaagtacaagtcactcagaacatcggtgagttgtcggttcatctcttccggatagggactgtatttgtcccaagtgcgcaacccagcctcgacatgcccaatttttgtctgctgataaaacgcagaaacgctagcggcaaaggtagtcgttgtatcgccatgaaccaagacaatatctggctgttctgtggcaataatctggcccaattgcaatatcacgttactggtgatatcaggcaatgtctgccgtgctttcatgatgttcaagtcgtaatcaggtttgatgtgaaaggttgtcaatacctgatcaagcatttcgcgatgctgcccggtgacaactgttacttcattgaattgatcatgacattgtttaagtctttgtacgattggagccattttgattgcttccgggcgcgttccgaacacggttattactttaagtttgggcattaaggaatctcctcgtatattttgtgactggtacattagcggttcaaattgttggcatacttgatcacaaggtagtctgggtatcccatgaaacattggaagaacggtgtttcacaaatgatatcctgtagtttgcaaaatgatttgagcgtccgaccaactttggaagagaagctaattgacaagttgctaccagcttggccaataaattgggctgatgaattgaaccctttcgatatgaggactacgcaaagcccctaaacatgcgttaaaggatcaaaattgacaagccagatcggtgtctagtaacgatagactaccgtgtgtcgtcgatagattgtcaacaatgcacgataaaaacccaaaccaaagaaaagcatatacatctactatacaacgataatggtgggctagctgtcatgacgtcatttaacggccaactttgcggcggttattcagcttggtccggacaatcccggacatgagaacaaattcaggcctcaattgtattggcttcaaccctgtgtcaacccgattgaaatcaaattgctaatgacaaagaatactgcagtaacagccgttccccacctcaaaaagacgtttaaaagttttttgggcgaaatatacttatattgctctgtatatattctgacaatgatatatataaaggaaaaatttaagaaaagcagtgttcgtggtccagatgcgtaaacggttggtgaaaagccaacagccacagccgttaataaacccgaaattaaaacaacgtcaagaaaaagaccagttgaaagtttttcaaaagcatttaacaaaacaattaaaactgcagcgaaaatcaaggaatacagtacaaaaggaacataacttgtaaagttgaagtagttagttgccccaactctagcttgatcagcaacgtcattaaataattgatcaaactttggagagtatatgatgacaattggtttcaaaattgtacgcgtcaagacaaaggctaagggaacgatccccgtggcaacgagtactttggaacgtcgctgagatgtcacggcaacaagaaaaatcatgaatgcaaagcacagaaacaagaaactgttatcagtcatctctgaaaaagcgtgattaacacctatgacaaatttgtccacaactgtcagtccggaaaaatcaagcatgttatccttagtctctgtgacaagtctcaatttattcccgggagaatataaagcaaatacgatgttggcaattgagatggcgtattgtagcacagtaaaaatgaaccctaaaatggtgaaacgacgaaaatagcacatggccagtgaaaagtatgtcagcaagcagagatacataattccaaatgtttcaaaatttgtggcaaatgctaaagcaaaaagcgccagtaaagcaggaacgacccctactttcttttgattataaattctatcaagtaaaaccattgcgtaactgcccattgcaagtggccataaatagttaattgttgtcgccatccacccagccgattgcatctgtatgatcggataaatgaatacaagtgaaatcactaaataattatgcttataatgtgtcaatgccatgagagaccatatcaacagcatccacattaaagtatcaataaccgcccacgttgttgtgtgcataccgctagacaatcttattaacggagcctctataagaacacgtgaggtccatgaactataacgccaataaagtacagataaaagcgacgaatgatcaatgaggtgggaaaaaacggcgatagcatcaccaacatattcacgcataaagatatgttctaccagcaagactagaaaagctatgcccaacgcagaataccgagaatctcttgaaacctttgaccaaattttcttaatcattttataccaccaatttgtaatctatacctgtcactagtagtttaaactctctgctgaacagtccacgaacatcaaattgttcgcccaacttcagcgaagaccttaaagcatgccagcgcctacagtttgttaccgctcactggtcgttaaaatttatactagcagcgagcaacgttagaggataactgtttctctttctttatttttagcctctataacctgccctagtctgcaggtaagttcaactgtatgaaataccaatagcaataaagttattgatgactgaaaagactgtaaaagctataagcccccattttgcaataaagttcagatacatgttttgactaataaatggtttagatttttcatacataattgtgatgatataaatcaaaatgatatccaagaaaaggaaagtccgcggtccagacacatacatcgatggtgaaaatccaaccgcaacagttgttaataggccagatacaaacacaactgttaaaaatatgccaaagttaaagtttttaaaagcattgcataaaacaagtaatatcgaaataagtaacacaacatacaaaagaaatggtatgtagtacatcacattgaaataattaagcgcgtcgattctttgttgttctgctgcgtccttaaacaaggcactaaattctggtaaataaactttagcaattggtgcaatgatggtccgagcaagaacaaacgaaaaaggtataaacgcagccacaagtattcttcgcgatttgctttttaaaaatagcgcaataacaaccaacattatcgtaaacaaaaagaagaagaagttcttgtctgttaattctgagaatgtatgggtatatcccattactaacttgtcaaacgggcctaaattggcaaaatctagcatacgaaatttagtttcgacaagcactcgtgctttgtttccaggagctatcaaagcaagtccaacgtttgctatacaaattagatattgagaagcggtgaataaaacaccaagtgtggacacgcgtcgctttaaaatcattgcaaccgcaaaaaaagagagtatgcacagatacatcacaccatatgtttcaaagttagtagcaaaagctagccccaaaagtgttacaagacctgttactatattggctttctcgtggtaataaattttataaagtgaaacaagggcgaatgtccctaaagcagctggccaaaaataattgatagacgtggccatccagccagccccattcatgagtgatagcggtatcattaacaccagtgacataattaagtagttgtgacggccgcgagttaacttcattaacgaccagagtaacagcatccacatcagtatatcgataattatccagactttaatatgcatgttttgtgacaatttcaacaaaacggattcgataaagattcttgaagtccaagttgtatatcgccaatgtaatgtcgcaagtaatgtagttcgatctaagtagtgagaaaaggcagttgctgcatctccggtatattcccgtataaacaggtgctgtaatgtaaccacgaaaaacgcaatacttagacattggagttgtgaattatcacgaatttttgcccctattctccttatcattttacaccacccaccttatagtctatcccagtcttaaccaaatctgtctgctgtttgttggcaacaagaaatccgattttatactttttttctttctcatttgtcatatactttattggaatgtaaccgtgaaaaccactgttcatataattgtaaacaccggcttttccacgcatcttagcaacatcatttcgatcctccatttttaaaggaaagatctgaacttctttgctgtcttttgtatacaaaacgaggctggtgacaaacttctgaggctcttgccccttaacgaaaatccagccagaaatttccgtataatcgcggttttttaaaccaagtgtttctatactatatttaacccgtttctttggcatgatcgaaaattttgttactggttcaacttttggcactgcatgactccgatattggacaaccacgcaaaccaaagcaacaagaagaccagtcccgataattagccaggaaataacctttctcttaaaactgtctgtcatttaatttttcctccttgaacaacgcccttttaagattaccatatgttgattgaatggtcagtcctttcttgaatcgttcagaaattaatcatgctgacttagaaattgttcaatagcaagagcactgacatactaaaacaccaccagatatgttattctggtggcgtttttaagatgatcactcttatcgttcagtaagtctacttcgtgggacaatgtaagtgacattaaaataattgacctattttcaaacctgaatgtagtttacttatcgacaatcttcaaaaagtctttcaaagcatcctgccacgtcggaatctcaaacccagtggccttcgtcttgctcaaatccaaaatcgaatgccgcggccgccatgctttttgcggatactccgctgacgataccggtttcaccgtgacatctttatcggccaagatggcactggcaaactcataccagttacaactgttgtcattggacaagtgatagataccataatctaaatgctgatcaacggcaaaggtcataaactcggctagcgtcttggtccatgatggacggccatattgatcgtccaccacggtcagttccttatgcgttttggcgaggttcaacatcgtgtagacaaagttgtgaccatattcaccaaagacccaagaagtccgaatgatgtagtacttcttaaggtacttttgcacctgctgttcgccttcgtatttagcccgcccatattcattgcgtggcgccggctgatcgtcaacggtgtaaatctccttactatcgccatcaaacacgtaatcggtgctgatgtaaaccaaggttgcatcaactttggccgctgctttagccaagttacgcgtaccgtcaacgttcaccaattgattgagcgcttttgcttcgtcttcggctttatcaacggctgtataggcagcacagtgatacaccacgtctggctgatagtccgcaaagtactgattaacggcggcttcatcggtaatatctaagtctttggcatcagttgcccgataagtaatgccgcgtgcatccaataagtggcgtagttcggtgcctagttggccttgtgcgccggtaatcaaaatcttcatctatcttctcctcgacattttaaaacttggcaagtccgatccattgcgttggtcgcaactcattgaccattctgcttgtacttcgcttcaaccgcagacttttcatcttgccaccagctacgatgatcggtgtaccacttaatggtgtccgccaagccttcttcaaagtcggtatattgcggtttccagcctaactcttcgcgggtcttggaagcgtcaatggcataacgcatatcatggcccgggcgatctttgacctgatcataatagtcagtcggtttgcccatgagcttcaagatcaattcgagcacggtcttgttatcctgttcgccattagccccgattaagtaagtttcgccaatcttgcctttagtcaaaatgtcccagatggcgctggaatgatcattggtgtgaatccaatcacggacattcttaccggtgccataaagttttggcttaataccattcaaaatattggtgatttgtcgcggaatgaacttttcaatatgttgataggggccatagttattggagcaattagagatggtcgcccgaacgccaaaggaacgtgcccacgcatgaacaagcatgtcactcgccgctttggttgaagaataagggcttgaagggttgtaacgactgttgatcgtgaacttttcacctgggccttcgccatggccgggtagatcttcacgtaacggtaaatcaccataaacttcatcggttgagatgtggtggaagcgaacatcatacttacgggccgcttctaacaaagtataggtgccaatcacgttactgtgtaagaatggatccggattaatcagtgaattgtcattatgactttcagccgcaaagttaaccacggtgtccacttgacccatcagtttgtcaaccagttctttatcggcaatatcgccaacaactaatttaacccgatcgcccaaaacatcttcgatattggctttattgccggcataagtcagcttatccaacaccatgatctgaacatctggatggttcttgtaaacaaaatggacaaagtttgagccgataaagccggccccgcctgtaatcataagtttcatgtttaaatctccccgtaaacaaagttattctcggcatcttttaattgcggatgatgctgatctttctccgacataatcagatgtgccgttgacattggccagtcaatcccgatatccggatcatcaaacgcgatgccgcgatcagcttcaggggcataataaccctcaactttataaacaaagttaacattgggcgtcaaagtaatgaagccatgcgcgaaccccttaggaaccaagagttggcggtgattatattgacttaagatataaccttcccactgaccatatgtcggtgagcccttgcgaatatccactaagacatcctcaacgactccggtcaccacccgcaccagctttgtttgcgcataaggtgccatttggtaatgcatgccgcgtaaaaccccagcttcggccgacagcgactgattgtcttggttgaaatcatttttaatcccggcctcgacaaacttttcccgggtatacgtctccgtgaaaaagccgcgattgtcaccgaagacatcggtttcaactaacttaacatcctttaatttggttggaataacttttaaactcaagtgtctttgcctcctaggcttcttcgtctgctaagcgcaaaatgtactgaccgtaatcattcttcttaagcggctgcgccagtttgcgtaattgatcgcgatcaatgtaacccatccggtaggctacttcttcaagacaggcaattttaagattctgccgcttctgaacggtctcaataaaactagccgcctcatgtaaggattcatgggtgccagtatctaaccaagcaaatcctcgacccaacagctcaacatcaagttggccacgttcgagatacgctttgttcacatccgtaatctctagttcgcctcgtggtgacggtttaaggttcttagcaatgtccaccacttggttgtcatagaaatacatgccggtaaccgcaaagttactctccggatgctctggcttttcgacaatcgattgcacatgatgctgctcgtcaaaggctactacgccaaaacgctcagggtcattgacttgatagccgaacaccgttgccccggttgttttagccgccgagcgctgcaccagcttggacaagccgctgccataaaagatattgtcgccgagaatcaagcacacagaatcatcgccaatgaagtcagccccgacaatgaaagcttccgccaggccatttggcttttcctgtattttgtaactaatattgagtcccagttgtttaccgtcttttaacagatcctgaaaacgatcaatatctctcggcgttgaaatgaccaagatatcgcgaatcccagccaacatcatggttgacaggggatagtagatcatcggcttatcatataccggtaccagttgcttagagattgcctccgtaatcggatacagtcgggtgccagaaccaccggctagaatgatacctttcatgaagatagatcctccctcatttaaaatttcaataagctgctattttgctttcggtttctacttcaaccgctcacatgttacatgataccagtttacgcttacaagctgaactaaaagcaggaaaactttaaacatacccaacaaatcaatcatgacaaagccatccaaaaataaggcttatttgttacttattagcatgttgccttagttaagaaaaaacggcctaaaagaaaataaggccgtttccagaattgtcttaaatcgattacttacaccttgtgatagtgccagtaacagacatgcatgggcgtcatctgtgcgtaatcgtcataatgatctactgactcgttaagaagttcaaccaacctaagcaatgtctagtgctcgcttatcaatccagtaaaggctgccattagctaacttaatttggacaaaggttcccttcgccgttctcttttcttcgagtgcagtaaagtgctgtccattaagtgctttagcattcgtattacctactgcagttgccacactggtgaagaatggtccagagacgtatagaccatcggcacttgaactttggttgatgaccccagaataatcaaccttcttatctgacaggatcttatcatacttatcaatggctaaggctcgcttgtccgtccaataaacgctgccatcatttaatttaaccttgacaaatgttcccttagcagttttatcctcttcaaatgctgtaaaatgttgcccattaagtgctttggcattcgtattacccaccgcagttgcaacactagtaaagaatggaccagaagcatacaaaccatctgcgcgcgaactctaatcaaagctgcctgtataagaaaccgctgttgttgaaatgaccttatcatatcgatcaatggctaatgcacgtttatcaacccaataaatttttccatcattcagcttgatttcaacaaatgtgcccttggctgttgtgtcctcttcaagcgccgtgaagtgttgaccattaagtgccttggcattcgtattccctatggcagttgcgacactggtaaagaatggaccagctgtatacaaaccatctgcgcgtgagttttgatcaagactgcctgtataagaaaccggcgtctttgatgtaacggtgtcatattgttcaatcgccaacgcgcgtttatcaatccaatagacgctgccattattaaatcggatttgcacaaaagttcctttggctgttgtttcttcttgaagtgcagtgaaatgagctccgttgtatgctttggcagcagtattacctaccgacgtagcagcactggtataaaatggcgctgatgcatagagaccgtccgctcgtacgctctggtccaaagatccggaataagataccgttttttgcgaaacaattggatcgtagcttactgaactcggagcggtacttgtacttgcagcaccattttcacgcgtaaacaacccctgatagtctatcgaaacatcaagattctgactgtgcccaggaagatgtccggtagaagaaaattgccatgcgccaaagtcttgatcccatagcgagtttgcgcttggtgtatacggatactgcgcaatccaagtgcgatccttgccagttgttgaagtcaaagcgtccaaatgtttgtaataacgcattgtataggcaacatgattctggtaaccgcgctgggtcattgtctgccaaaaggctttcaagttcccagcaatgtctccactaacagcgtcagattcaatatcagcaacaaccgttacatttttaccgacattaagtgaatcaagtcgattagcaaaatagttagcttctgcaacggcagcactggccgaatcaaaggttgcataatgatatgcagaaacgaccatgccagcatttcgcgcaaacttaatttgatttgccgcaataccatttgtgtaataggttccttcagtgactttaacaacgacccctttaatccccaaattatgtaattgggtatagtcattttgtgtcatccagctttgccaatcagaaacatcaacaacgtcattacgcggaaccgatgaatcgcctatcgtaaagtttttcaaagtgtaatcgttagccgcaaacgtcgagatactgttttatccagtggttgtcgtgttatttccagcgtccaagacacttttttgcatcccaccagacatttgtgattcattcaaacttgattgagcagaaattgttgccccactattttctgctgcaaaagtcggtgttccaagaatcagtgttgaacacaaaaatgatgatgcgattgctgctgatgtccacaatgccccttttttcatgattaaattcctcctaagttaaaaactctgtaaaacaagcttaattagtgcctggtgatttaggctgcggtttctggccgaatttcagtcactttatagttgatttgataatgcaggccaccctgttcgaccacaatagaaattggtacagaaaaaagcttaaggaggaggtcgatatttgccaatgcaatcgcgctatccaccgttaccaccaaggactcagccgttctggtgttcactaagtcaagcccaagtgaacctttcaagaaggcaaacttgcgctcaatggcaccccgacgattttccgcactgacatcggctttgcgctgtttcggatccacatgtttgggctttcgacccagctttggcccattaagtttaatgcctagcttcttacacagattgatgttatctcgcgtgcgatagagagtatcgaccagcacctcatccggatattcacccactaggtcaaaagcatggtcaagcgttacttcaagatcagtgctttcgttaaatgaattgaagtcgaaacgctctacatcaatcacgccatccaacatggaacagtcaatcttggcgccaaactcaacggactgctttgccttacctcgcacgattggccggatatacggctgttgaaggctaacgatgcgattctcgacatggtgagtgtggttctcaaacatgaagagctgctgctcatagacttgtttaatcacttccagacgctgtgcttgccaatcagtgagctgaccgccttgcgcaagcagttccgccacatatcgcagatctcttcggatgtattgtagctgagcttgaagctgtttgcggcgttccttgttttgacgccgcggtttcctcgaaaaagcggtccacttaccttttgcttcacgtctgtatgtccgcggaatttccacacctaacccgtgggccagatctgtgaccatttgttcgagattcaaacgactctggttaagcagcgttgtatcttggggatacttgatcttgaccggaacggcagtcgcatcactaatcaaaacatgcgtcccctcaggtagatcggcctccaaccgctcgcgcgtgaagtcattagtaatgttgcggatcaaatctgagatggctgaaagccgttggcgaaagtgcaccaacgttgtgtgttcaaatggcttcttagcgcgatattcgggtaacccgatgaagtactgataggctggtgtatcacggatatcgtcgacaacttggcggtcggtcaggcctttcttcaacttgatcaacgttgcgccataaagcaatcgaaatggcttcgctgctcggccggtttttgaaggaaactgtaattggtatgcctcttcaagtttggcccatgggatcaattctgcatattgaacccactcgttgtccgggctgagcggtgttcccagagcgcttccaaaggattcaagtgacagttgcgttgctttttgacgataaaccatgatcaattcctccgataggtcagcgataagtgcaagggtaaatcccaaagcataggcatttcgggcaaataagggttgcacttattatacgccgaactattggtaaatcctattattaaagtacttttatagtttttcaccatccactaattatacattgattcgacaaactttaaaaaaacattctgattacaattcacaatcagcttagttgcattcattagtccccaaggtcttgccagttttcaaaaaaattccagaaaaagtagtgccgttgctttttctggaagtattattcgaatcaacttaaatgcgtaatatcctgctgaacaaccagatcatgcaacttctgccgttccggttcaatatcttcttccaacccctgtgaagatactttgtcaaacaggatcttgatcgtttgcaacaaaatccgcgcgtccaggaaaatactgtaggtcttaatgtatagcagatcaaacttgagcttgctatggtaatcggatgcatatttaccataaacctgtgcataccccgtaatacctgcccggacattgtgacgcaggtagtaatgcggctcctgctggttgaactggttgacaaaataaggacgctctggacgtggccccacgattgacatgtcaccttttaaaacgttaaaaatttgcggcaattcgtctaatcggaacttgcgtaggtacttgccaactggtgtaattcgcgaatcgtgcgctttagcaagaaccgggccagactttgcctctgccgttgccgacatggttcggaacttaagaatcttaaactctttttgattcaacgtaatccgcgtctgcttatagataacgggacccggagacgttagcttaaccaaaattgcagttaccagcatcagtggcgatgcgacaattaacatcaagataccaacaacaatgtcaaaagcacgctttagaatggcgctttctggtttgattcgaaactgagtaatacccatgacactttcatcttcaaagttcattaaattaggacgcagcatcatcagattttcgaaagtcgaaggtaaaagaatggttcgctcatttttgatgataagatcaataatttcacggcgttgctcatcggggagactcttagttaaataaaatatgtcgaccttatccatgatctttttggcattttcgacaaagtgatcggaaacaacataggtaactttatgtttattgtttttggctgaattaaaattttctagcacggccggaagttcatgttcataggaaagtacggccactttatagttactcgtaaaccgaatgtacatgtaatagatgaaaacgcgccagatgcctaagataagaatacttaacagaaacgaatagcccagcactaatcgtggaaacgcaaacagccggcccataaaggtaatcatcgtcaaaccggagatggtaataagttgtgccaaaaccgtgttgaagatgatgtcactaatgcgccgattatagtagacataaacacctaaaaagaagttaacgaacaagaacagcaaggaaatatagactgcagatcgttcgtacatatagaagttccactccggaatattccggccaaatcgccaataaaaggcaagtaggatacttagattaaaaagaccgacatcgccgatcattgttaacagccttttaacgccattccattcggcactctgtttcatacagcaaccctctcaatattgatatcttgacacgaaactaactgacccattatagcatatgggcagcattcgtcacttttgcaggatatcgttttaactgaatctagacaaccttcgtcaaaaccgccacctgacagtgtatgacaacccgtacttccatattggtcgcggcaaaaaaatgagcaccgttccctacagcccggctggcatgcactgctcctgacaagaaagatgatcggtcagcttctcaccgcctggccgatcattgtttactgaaccgacgccacatacttggcaagtccctgtgcaagtggcgtgtgggtcatgaagtcaaactgatccaacttgtccgtttgtgcatatgaatcgcgaatgtcaccaagacgcggggctttatgggtggcatgtaacgttttgccagtgagtttttcaagctctttggcaacctgatttaaggtggtctgtttgccgttagcaacgttgaaaacatcatcccgagcgcttggggtctctaacaagccgcgaatcgcatgcaccacatcaccaacatagatgaaatcgcgagtctgttcgccatcgccaaagaaggtgaatggtttgtcttcttgcaacgccgccatcatgatcgacaataccccactataaggcgacttagggttttgcttcggcccgtatacgttgaaaaagcgcgtgcaaaccattggcatgtcataaagccggccataattcaaaaccgcgcgttccgtggcaaatttgtcaactgcatattgggttagcggtttaacggccatgtcttctttcttaggtagctcaggagaatcaccataaactgcagcggaacttgcaaagaataactttttataaggtattttctgggtgcgcaaggtttcaatgatgttcaggttcgcttcctgattaacctgatgtgtcgcgtacggccgttcaaccgaatcagcaacactggcaatagcagccaacaagacaatgtaatcaaatcggccttccatcaaaagctgggacatgaaggcatgatccgtgatgctatgttcataaaaggtaatccggctagaatccggaatattggtccgcaagcccattgataaatcatcgacaatggttatcgtattgtcaggatccgtcaacaaaagctccgtcaaattggaaccgataaacccggcgccaccggtcactaagtagctgctcaagataatttcctccgtcttgcttgttttatttctctctcatggtatcacagcagcgaccagaccaccgcagctaatcgcaaatgttaggaaaatgataagaaccggtcaacgccttaactgttacccctttgcagcagcctgaccgatcatttgcttgaacggggacttaccagccgtcataggcaatttgtggtcaaaaagtaacagcaacccaaatcggttcaaaactttgccaagtgtggtgaggcaacgtacccacttacgaaaggaccgattgttgcctatatttaaaattgaggtgacaccgtgtcaccatctgtacgcttttgccagatgattttgcaaaataactaaagcaaatcggtcctgaccagacaaagttcgtctgccgaggaccgattttaatggctattaaagcactgatatcgagaatcattcaattcgactgtaccaaccgccgatccaaccaccgacttgccaaagataacgcatagttcaccacaaaatacatcacggccaatgccacaaacattggaatcatgtagttaatattttgaccataaatgatttgcgcgtgatacgtcgcttctggcagtaaaatgatcgtcgccagtgatgtgtctttgaccagcgaaataaactggctgacaatcggtgggatcattttcttcaatgcttggggcatgataatgtaccgcatcgcctgatagaaggtcaaaccgttactgcgcgccgcttccatctgcccgcgcggtacggcgttgatgcctgagcgaacgatttctgccaacattgccgattcaaagatgctcatcgcaacaatagcggcaacaatgacgttaagccggatgccaatgtctggcaaagcgaagtaagtgaagaatagaatcagcagtagcggcaaattacgaatgacgtcaatgacaaagccaaccgccgccgaaaaatattttatcttgacatagcgtgccaagcccaaaataaccccaaggacaaagctgaagaaaatcgaggcaatcgagacttccaaagtcacccctaagccttggagcaggtaccgtaaattaatccacgaatacgcatcaacaaaattttgcataaaacctgctcctttctaggcggtcacccattttttctcgagataacgcatcaggtaactcaacggcatcgtcaaaatcaaatagaaaatgccgacgattaagtacgtatcaaaagtcgaaaaagttgtcgccgcaattaatttaccttggtacatcagatcaaatccggcaacgaaggccagaacggaactattttttaccaaattgataaattgattgcccagtggtggaatgacaattttaaatgcctggggaaaaataatctgcgtcatcgcctgcgtataagtcatcccgatactccgcgcaccttccatctggccgctgggaactgcttcaatccccgcgcgcacggtttctgcgatgaaggcactcgtgtaaatcaacaggccaatggtgcccgcggtaaagccatcgattttgacaataaactggggcacgatcacgtagaatgccaaagtaataactagcagcggaatgttgcgcacaacttcgacataaattcgcccgatgactcgtaacggtttaaacggcgagatttccatgagtgcaaataatgtcccgacaatcaagctgccaatcaaagctaagatgctcgctgctaacgtgaaaccaagtccggaaagaaaggtgttccaattattggtaagaattgaccacatgttattccacctccttaagactgaatcctggcacatcgccgaaccacttcttgattagctttgcataagtcccgttttgtttgagttgtttgatcgccttattaaccgcgttgacaaacggcttctggcctttgttaatcgcaatcccgtatggctctttagtgaaggtgcccccggtgacaatatagttcttatcctgttctgacatcccgtataaaatcccattgtcagtggtcaaggcatcaccttggcctgatttcaaagcggtaaacgcctgcgcataatcggctaactgcagaacagtggtgtcgggagcagcttttttaacattatcaactgaattggacccttgcacgccgataactttggtgcctttcttcaaatccttcactgacttaatcggactgccttttttaactaaaagactttgcccggcattaaagtaaacatcggaaaagtccagaatcttttggcgctccggggtaatcgtcatggtagcgatcaccgcgtccaggttcccacctttaatcatcggcacgcgggtatcactggtcacctgaaccagctgggcgttcccttttttgcctaaaatctgcttggtaatcgccttggccatatcaacatcaaagccttcaattttaccggttttaatgttcatcaagccaaacagacgggtatcggccttgacgccccaaataatcgtattggttgccttggcgttcgctaaaatatcacgatccgccacacttttgccacagctgcttaacggtatcatcaatagtaacaacaccagtggcaggagcatgcgtttccacatttttgccattttaatgtccctcctcgtgagcgccagccagcgtgggtagaagccggattgtgtggtcattgcgaccaaggttcttacacacaagtttctggtcgggagccaacgcattatcgtagcacgagtcctcccggcggaaatgtcccgccagcaaacgcctcataactggaatcaatcctcaactggtcttgtcacactaatgattgatgatcttactgataaactctttggcgcgaggttcttgcggatcgtcgaagaactggttgacatcggttgaatcgactagaatcttgccatcgtccataaagacaatccgattgccgacatggcgggcaaaccccatttcgtgggttaccaccaccatcgtcatgccttgttcggcgatcttctgcataacgtccagcacatccccgatcatttccggatccaaggcactggttggctcgtcaaacaagatggctttaggcttcatcgccagactgcgggcaatggccacgcgctgttgttggcccccggataactcacccggaaaactgtctgccttactctccagtccaaccatcttaagcagatcgcgggcttcctgttcaacttccgccttgtctcgcttcaagactaaatcagggcctaaagtgatgttttgcaagacattcttattcgcatacaaattaaaatgctgaaagaccatgccgacatttttacgaatccggttcatatcggtttttttgtctgccaagtcaaagtcattgacaatcaattgtccggaagtaattcgttcaagaccattgatgcaccgcaaaaccgtacttttaccagaacctgaaggcccgataatggtcaccacctcaccgcgatcgatggttagattaatattttttaaggcttggaatttgccaaaatacttgttaacatcgtgaaattcgatcatagacatgttcgaggacctccttgggttcgcttgctcttatcatggattttacagataaaattaatgatacgcaaatatttcttttcaaaaagtcaagttttatgaccaccgaatccgtaaaactcccgaaactcaggattccgcaccatccacgattttcatcgtgacttacccgtgaacactgatcaccatacgacactttaatatcagccaactatcagcattaaaaaagagccgcgagttttaatggcactttcaaaactcgcgactcatatgcatttttattcttaaccatctgacagtagcgactacctaccgctgatgacgccgactttcacgcgtaggcaacggcggttcttccgcggaagacgttgctttgttttctgtcacagaagtccgcgcctcttctcgtgttggcaaagttgcaggagcggccggctgttcaccttcgcttgcagccggcgtcttatcctgataagccagctgcaccgttaaactgtatggctgcttctccttgcgcaaaccactgcgaccgagtaacttttgctctccgccaattaaaaagacattggcggcgactagatgataatcacgttgcgcctccgctgccggtaacaaaccaactcgttcaatggttgctagcggcttagccatcagcgcattcaagccgccagtgatgattagctcgtgatccgtgtgctgcaaatcgaaaaacggaattggaaacggcgcgccaatagctagaactggctgctgggtttcttgagccacgcgactaatcgctttgtcatcaagcccttgataattcagactcaagacgccttgtttaaccagactggcaactaagtcatccaaattggcttgctgctcagccgtcatggtcacatccgccgtcagcaattgatcctgggtaaacacgccactggccggcgctgcccccagttgcgttttcaattcgttttcggcagcagttttcttagccgaattactgcccaaccacttctcaactgtcggcgaaatatcaaaccgggttgtcttatttgtaaaatagtataagaagtttaaggcaataaaatacaaaaagacaacaaacgccagcatgaacaatgcaccacgaattcgaaaatccggataccgtaagttttgaatggcgatgtaaagtaggtaaaaattggcgacaaacgctatccacgtgaaggcttttccttttggcttgtcagcaatattaaagtagccaagtacgcggttgataatatcaattacagttaacatcatctcatcctttccgcggcttattgaccgccactactggtggtatccgtctcttggccattatcagtactcgtttgatcggatgcttggtcgttactggtcgtggtgctgcttggcgttgaggcggatgccgttgaagcggtcgaagcactcggcgttgaagcagaagcctcggtactcgttgtttctttttcaccagatggatgactcgcctgtacctgcgactgacttgctgcagatggctgcgaagttgatgtttgacttggctcagcttttgaagacgctgattgtgcagcccgtgaagccgattcggattttatttttgaaaccaattcactttgttcggttgccgattttggttgattgaccggattaatcgtattcacaatattataggcactaatcaggacaatgagcgaaacaatggcagtcggcggtaataatggcggtgttcgataagccatgaagccagctcctttcattcatcgattcattttaccctaaaaacagcccgaagcatcttaagttaccgctaaaattatacgacattctaagcagcagccaaaacggcgtagcgaaaccgctgctttgaactatctttaccaacattctatcgcctgcatggaaaaggcagttggtaaataaacgaaacgacatcagataattgatctgatgccgcctcatttagtctaccgttaaatttttttcacagcgcttcagctaccgattagcgtttttcaagcgatcagcatgttcttgacacgctgcgcacaagccgtagagttcaaaattatggctctgaatcttagcgccgggtacctgttcttcaaaataattcaagggacacatttttaattcgatcactttgccgcagttggtacaaataaaatgatggtggtgcggatgttgaaagtcgcactgaagcttaacgacaatttgatcgtcttccatacggctttcaacgatgcccatttcaatgaacgacttcacattgcggtatatcgtatcatgcgacaccccgggaaattgcgtgcgcatataccgatcgagaatcgtcaccgccgtgtaccgatgctgatttctacctaaataatcaaccatcgattcacgctgcttggtgacgcggtagccatgctgttttaactgcttcaaagcaatcgctgtgttatccataagaggctcctttggcttgacacttgaattctagacgtgtattctatcaaatcgtactggttacgattagcaacttacagtgtatcacgcctgataggaggaagcaacatggctgaaaaagccgattacgcatctgctgcacgccgtctcaaaagtaaaaaccccaaaacccgttcacgagcaaaacgggtgatcaaggcagttaagaaaacgacaaaataacaatcagaacggcaccttattgtcgctgccatgtcgaaaattgtaaagtaaaaacgttaaaggcctctaacgacaagatttttgtcattagaggccttttagtgctgccatcaagcattttatcgacacattaccagtctactagacattttacaaaattaatcgcgataattctcgaccaaggcctttttgccaccatgtcacttctgttcagtgtcgaccgacaaaaagccacaacttttaagcgccaagtccttcatgaaccggtcaatctgctgtcgcgcttcatcccaacgatcatttttaatgactgtcgcaaacggtttaagttcatcaggcaaggttaagtcgcgtttgtattcagggcttttcaatcgcgctgccaccatgttcggctcatctcctcgaccaagcaggcgatctttcaaaaccgtgggatcgtcaatggtcagaaacaaaacgacgacttcttttggcagctcacgaacatacgtaatcgcgcctttggtatccaaaacgatgcttaggaagggatgcttagcccagttcttctccagcgactcatgtgatgacccatattcatagccggcataagtgactttttcaataaaatgcttagtcgcaaaacttgccggtgtctcaaaataataatcaaccccgttttgttctccagtccgcggtggccgcgttgtgtgagtcatcacccgatgaattcggtagttgtcgcgcagatacgcgctcaccgttgttttaccagtccctgttgcccctgtgatcacaatcaacttatgcgcagccttcatgagcagcctccttaaatgattgcctcgattgtaccaaacctacgccgattcgtcagctcaaaatcaacgacccttgcgctttgatgccaaacttgctgaccgggttcacttacgtcaaatcctggtaaaaagcaatcacaccaactttactactttgaacaaaaccaatattttcgtaaaaggcgcgagtttggggctgatcatcggttaaaaggacccgttgacgaacctgtggaaactgatctactaatgcgtttaccaattgccgcccgatcccctgccgttgataactgggcaaaacgagtaaatcctgaataaataaaaacgtctcgccatcgccaaccgcccgaatcaaaccgactaaccgatcgccatcatgagcccccagcacgcttaacgattgcgctatcgcccgctcaagtttcttcggatctcgcgtgtacatgttccaaccaaccgcttgataaagggcaagcacatctgcctgatttaactgacgctgatcaattttaatcataataagcctcctcctgaacgtccaccgacatcaacgttgatgaacgctttaatgagttctattgtcgcatacattcatactcaatggatatgttcaggctcgcgtaatcgtaacgcgctcaccggcgcagggatctgcgtgtaaggaccttggtcgcaatggccaaagcccagccatcacgcccaaggctatttgacttcagaaagtggctagtaggcagtaaagtttcttatttaggcaattaagagaacagacattgcgttctataacgcgctcacagtcgcagcaatctacgtgtaaggacctctagcctaaatggccaaagaccagccatttaggctagaggccacttacactccgattgctaagcgctcctgttcgcgcttactaaaaaagaccggtcgccatgaccgatcttttagttactatttgcaggatgtgaacgataaattagagacgacggccgaagcttggtgcaaagtaagcaacactttgaaccgtaacgttttgtcctggctccggtgcgtggatgtactggccgttaccgatataaacgccaacgtgataagcattaccaacgctaccccagaagaccaagtcgccagcctggagatcggaaaccgaaacatatgagccaagtgtgctttgcgcctgagaggtacgtggcaggctaattccggcttctttagctgcgtaatagattaagcctgagcagtcaaacccagcaggtgatgtgccggcgtaaacatacggtacgccgaggtatttagcggcgttaccggcgatgctgccaccggaaacggaaactgtgctgcttccagctgaagcgggagcctgagaagatgcagctttactagagccgagactatttgaagaagcggttgtgctagaggaagcagaagtgcttgatgcgctagcggtggaactagcaacggctgtcactgctttttgagccgcctcagctttggcagcttcatcagcggccatggctgccagcttttctttgttagcatcaatcgtttgttgagcatcggcagctgccttatcagcatccgcctttaagccatcaatcttggctttatcactttcaagctggctcttggttgcaaccaggttcttttggttagcttcctgagcagctttcaggtttttaaccttggcttcggagtctttaacggcttgcaaagcttcggcgctggcttgactcaacttgctaactgtcaatgaccggccgacaagatctgtcagactgtcggagttcaaaatgaagtcaaaatagacattgccagtaaccgagtcgccggcacgcttttgcaaagaaatcagctgatccttcaaattgctcttacgcttgctgacttcctgattggcttttgtcagttgtgctgcgaaatcagcaatcttggcctgactgtccttgatcttggcttcggcatcctgaatcgccagaaccttattggaaacctcgttgttcaatttggcgcttttttcgttggcagtctgaacctgtttcaacaaatcgtcattttgcgcttgcaggctcgctttgtcgtctgccgcatgaacggttgttgccgcgaaacccgaaaccccaacaccggctaatgttgcaaccgtgatggcacccgtaaccaattgctttaatctcattttatcgccactcctgctctcattttgttcacaaggttcacactaacactgaactgttacaaactcgttacagggtggttaccatcagaatacttttgcgattacttcagcagcactttatgatcattttaataaccattttatttctaagttatatttgcgtttttaaatttaaaaaaagtcaggaataaaagcggctctttactcctgacttcctgcttattttgtcatttaatgctaaccggattgaaagtagccgcgactcgctacctagcttcattcatcgtctcaccgtaaccgaattacttgatttcaactaggaagtaccgcttctttccgcgccggacgatgacatattgaccatcaaaatgcgtgcttggatcaacttcaaagtctaagtcgcgttgacgggagccattgatggtgatcgcaccgttttgaatatcttcccgggcctgccgccgacttggttcgatcttggtggtatctaccaaccaggtcacaatgttttctgccgtttgcggcgcttcaaccgttggaaattgcttaaaacctttcttaatatcatcagcacttaaatccgcaacatcgcctgagaaaagtgccgcactgatactttcggcttgatcaactgctttttgtccatgaacaaacttggtaacggcacgggctaattcacgctgagctgcacgtttttccggatgcgtcttagtggcctcaaccaactcggcaatttcatcacgagataggaacgtgaagaacttgaggaatttttcgacatccgcatcgtcttgattaaaccagaactggtagaactcgtatggtgacgtcttttccggatccagccaaaccgctccgccagctgatttaccgaacttagtaccatccgctttcaacatcagcggattggtcaagccgtaagcacgggcgtcaggtccctcaaatcggtgaatcaaatcaatgccggccgtgatgttcccccactgatccgccccaccgatttgcagctgcacatcttcatgcttaaacaaatggaggaaatcaaccgactgtaaaatctggtaggtgaattcagtgtaagaaatgccagtctcaagccgacttgccacgacttccttattcagcatattattcaccgagaacaacttaccgtaatcccgtaaaaagtcgagcatcgaaattttggaaagccaatcgtaattgtccacaattcgaaaatcgtcggttccaaacagattctccatctgcgccgtcagtttcttcttgttcgtcgcaatggtctccattgtctgcaagaccctttccgagttgcggccagatggatccccaatcgaaccggttccgccaccgattaaaatgaccggtcgatgtcccattaactggaagcgcttgagaatcatgaaaggaatcagatgaccgacatgcagagaatcgccggttgggtcggtaccacagtatacgctaaccgccttttcttcggttaacttgcgcagcccggcttcatcggtcagctgattcagcgcaccccgccactttaattcatctaaaatctgtccttgctgtgtttctgtcattagaaaaatcctcctcgttacgatatggctagcatgatcagcacgttagcctcgagccaaaatgtacctgattacgaaaaaagtcgtccctgatcaactaagatcagggacgactttcaccgcggtaccacccaaattatgctttgcatcactctcatggatatcggcatgacccgcggccagaattcattgagctgtaattcgtgctatcaggtggaacggtttgcagcaaccaccgtttttctgaaagcctacctagataacactactgcgactcagctggtaaattttatagctcaaattttaacacatgcacgctatttgtacagaggcagtcgttaaactcatccacgaaaaccgcgcgctaactcccaaaagcctcgtttcggaaaatccaccgcaagcttacggatcttgcggcgcatcttccggtggtaaatcggccggataagtttttacatcggcatccaaaatatcgtacgcatccatcaatttgcgttcgactcgttcgcctaattcataagaatccgccacggtcatcttcggatccacccgaatgccgatcgtcagcagcaccgcatcgccggcataacgcgcttcaatgctttgaaccccgagaactccggaacctgcgtaattgtttgccgataagccgcaattttcttggtgtcaaacccatctgtcaattcaaaaatggcgtcacgaagaattgtccaagcggcatataaaatcaaaaggccgaccgcaatcgctgcgccgccatccagccacagccacccagctttcgcacctagaatggccaataaagtcccaccgctagtcgcagcatcggaaaaactatctttagacgctgtccgtaaaacgctgctgtccagttgcttggcgcgaatatgattcatcaacgaaacactcgccatggccacccccgcagctaggctcacgtaaaccgccaaaacaccgggcacttgcactttaccttggtaccatgcctgcaagccatggtagccatcaagcaccacgtccagaccaacgactaacataatcagacctgaaaataaggttgcaatcgtttgaaatcgccagtgcccaaatcgatgctcactgtcaggtcgttgctgggaaacttgcagcccccataataagataagcgccgaagccacacctgtcagattattcaagccatctgccgccaatgcccgggaatgtgctaattgcgcgatccacaattcggccactgttaaaccaccataaacgaccagattcaacgccgctgcatgctgggcacttttcagacgggcaaatcggcgttgttcatcttttaaaatattgcgaccagcatccatactaattccccctcgtcagaaaagtcattagaggctattataaagcaaaattgattttaatcatcgtttaaacacgttttttaacggcatcaagcgctttcttacaaaacttttacataggaataacctgttatttgcattagccatggttcacgctgaacaatacgacttttgtcacacttgggcgatctggcgcttcaaggcgttggttaaccgctcaagccgggcaattgtatcgtttaaggtcaaataataataaaccatattgccttcacggcgggatccaaccatcccaatatctttcagatgtttgagatgatgcgaggtagctggctgcgataatccgattgcatcagccagatcattaacactaacgcctacgtgattatcggccgcaccgagaatcataatcagcttttgccgacttgaattggataaggcatttaagtggccgatatcctgcttgaattcttttaatgcttcctgttgtgctgaactatatgccgccatagttggcctcctcatgaattgcgctgagcacacgcggtgaatcaattgacattcacaacgaataatacctgaaatcataacgattgcaacaaatatgcaaaccgttcatactatgcattaggataatcaatgactacttggaggtgcaatatgacaacgacaacaacctttcacggcttaggtgcggacaatacgttaaccgtttatgccgatggtgccaacgaattacttaatcaaagtgtcagtatgattcaggcttatgcgcatttgctatcgctttatgatgacgaatcgttgctaaccatgattaatgcccaggccggtaaaacaccggtccacattccggtacgaccggtgtttaatctcatcgcccaagcagtagcctggagcaaacgtggtctaggctacaatgcgttaatcggcccgatcgtcaagttatggcgaattggctttgccgatgcgcgtgttccatccgccagtgaagttaatgcagccctagctttaaccgacccgaatctagtcgagcttgattcggaaaatcaaaccgtctttttacctaaagaaggaatggttttggatcttggcggaattgccaaaggatttattgtcgaccaagtctatgatttatgggataaaaccggggttgaaggcggcttgattgacttaggtggcaaccagcgcctcgttggtaaagcggccagtggcattcctttgtggcagtggccaattgcggatccccgccatcccggccagcgcagcattgcaacgctgacaaccgagccaaaagccgttgtgacaaccggcatttttgaacgccattcagagattgccggcaaagaataccaccaccttatcgatcctaataccggttatccggtcgagtcgaacatggccagcatcactgtcattgccgataatggtcttatcggtgacgtgttatcttcagtcggtttctacgctggcgtcccggctggttacgatgcgatcgaagcagaaggtcaggaagcgatttttgtcaccaaagacacccgtgtttatcaaactagcggattacgcgaaacgcttgcggtgacgatgtagatcaaccgttttaactggcgactcaaaaagcagcagccattttttggttgctgctttttgcgatctctaatttagcacctctaacagctacctatagctacaatcccgactttttagatagcctgccaaatcacgcttccaggcggcaccatggttcccattggcaaaagtgaccgcagattagccggaacgagcttggcattcggatcttgtaaaacctgaggcgagcaggtggggttggctaagacgaccaacgtctgggcctcgttttgccggacaaagccgaggctgtcttcaaacgtgaacgggaaaaatgctgcatcggctgctaaggctggttgatcgatccgcgtctgtaacgcaatctgatacatatccaaaatggcttgatcttcgtgcccccatggataaaaggcgcggttgtccggatccttgccgccggttaatcctgcctcatcgccataataaagacaaggtacccccggcagccaataaagaagtgacacaatcaattgtaacttacgccgatcaccattcaacacggtcaagattcgcgccgtatcatgcgtgccaatgttattaaaattaaacgcaaacgcattgggcggatagttttccttgagcgtcattaactggcggacaaaaccggccgcgctgagttgaccgttgacaaaatcaatcaacatcgaccgcaacgggtaattcatcacggcgttcagctcgccaccttcaaaatactggcggcgtttgccataagcctgcttattcgatgcatcttcccaaacctcaccgatcaaaacccggtcaggaaactgatccaatgtcgtccgaatttgatgaataaagtcgtcagtcagctcatcggcgacatccaaacgccagccatccacgcccagatcggtccaataactgatcaccgaatcttttttagcggcaataaaattgtgaaaatcctgattgtctttattaatcgccgggaggtctttaaccccccaccagctgttatagtcatcaggaaatcttttaaatgaaaaccacgatgcgtacggtgaatccagactgttcgccgcaccaacatcgtcatattcgttcacggcattgaaataccggctgtcggcaccgacatgattgaacacaccatccagaatcacatgcatccccagctgatgagccgccgccagaaactgcttgaaatcatgcaatgtacctaacacttcatcaatcgcataataatcaccggtatcatagcggtgattgctacgcgcctgaaaaattggactcagataaagcgcattaatcccccgtgcagctaacagcggcaatttttgctgaataccggttaagttaccaccataaaaatcccagcgcaacacttcgccattggtaccgcgaatatacattggccgatccgactggcgcccatagataaaagaattggctttcggtgcgttgacgtggccatccgcattcccgttattaaaccggtccacgaaaatatgataaaaccgcgcatgccgataccattccggcactgggtcaaactcattgaccacggtcagctgataactgttcacatcggcattttccggataaacctgcccgatcccgccaaaaccgccatcaaccgcaccaaagcgttggcggccttcatcggtttgcagttcaaaatggtaaaaccataaaccagccgtctgcggggcaaaactcaccgtataaccattcgggcttttggtcattggcaatgtctcggtttgatccccgcgcccatccggcatgataatcagcgaggcttgcgtcaccgcaccgtcagctttagccgtgaaatgaatcgttgttgctttccgaactgccccaaaaggctgccgatcggtgaatgaatcaaattgaaacatctttttcctccatgtgacgcatcagttgcccaagccatcatcttctggcgtttgcgggaccacatgccaaatatcgtgaccatagcgctgaaccgtaaagtctgcggaaaagcgcccactttctgcaatgttcaccaacgccttcttcgcccaggcttgcggctgttgatacaaggcatccagcttggcattagcggctaaataactttcaaagtcagctaacacaaaatattcatcgttatacgtcagcaaggaattgaaaatatcgcggccttccgtttcaattcccggaatctgaccattaaccagcatatccaacaccgcatgcaaccgcggatccttttcataaaagtcgcgggcccggtaatcaccgcgccgataataaccggcaatctcgtcttcggttaagccgaaaatttcgatgttatcatcgcccaccgcatttttaatctcgatgttggccccatccagagttgctaaggttaacgcaccggcactcatgagcttcatgttactggtgccactggcttctttcccagctgtggaaatctgttcggagatatcagcagcagggataatcttttcagccatcgtcacaccgtagttaggtaagaaaacgacttgcaaataagggctgacttccggatcaccgttcaccatatccgctaccgcattcataaccttgatgatctctttagcatacacataactgggtgcggccttggctccgaaaatatgcaggcgtttcggtcgtttttcaccgcgtttaagcgctaaatacgcatctaaaattcctaatacatgtaaaagctggcgtttataagcatgcagccgtttaatctgcacatcgaaaatagcatccgggtcaaccttaacgtgcacggtttgatcgatgtacttagccaatgcccgtttattttcggctttagcggcattcaggtcggacaaaaagtgcggatcatcgctgaaatcatgtaacttccgcaatgccaacggatttttccgccaggtagtgccaatttttttatccagtaagtgcgccagcggacggtcgccgatttgaatccagcgccgtggggtaatgccattggtcttattattgaaccgctccggaaaaatctcgaacaggtcgtgcaaaacatcttttttcaataactcactatggatcggggccacgccgttgatcgcgtgggagccaatggttgctaagtaagccatccgtacctgcccgttacctaaaggagcaatacgatcaatcatggcttgcccaaactgcggaacaaaggccagacggaagcgccgatcgatttcctgaacgatttgataaatccgcggcaacagaccactgaacatatcaatcggccagacttcaagtgcttcggatagcaacgtatggttggtgtaactcataacctttaatgtaatccgccatgcctcgttccaactgacatgttcatcatccatcaaaacccgcatcaactcaggaatcgccatcgccgggtgggtgtcattaatatgaatcgcaacccgatcggcaaaccccgccatgctgttgtgcgtccgccggtaatgacgaacaatactctgaattccggcactggtgaagaaatactcttggcgcaaccgcaattcttttccggcattgtcagagtcatccggatacaggatctgggtgatttgattgatgcgttctttttgttccaaggtaaaccgcgagccggcattaatcggcgcttcagcggaccatagccgcagattgttcacgacgccattgtgatacccgaccatggcaacatcataaggcacggctagcacatcgtcagtttggtgatagatcacccgcaaattaccgctgcgacttggttttaattccacccagccgccgaatttaatcgtgaccgcccgattttccttgcgcgtctcccatgggaacccattgcgcatccaatcatctggcagttcaacttgataaccgttaacaaaggcttgtttaaataacccatattgatagcgaatgccattgccattgccggccatccccacactggccatcgcatccatgaacgccgacgctaatcgtcccagcccaccgttgcctaacccaggatccgcctcggcatcaaaaatcttctgcggatgcaagtccaaggcatgtaaccctgcctcaaccgcatccaaaatacccagattcagcaaattagactgcaacagccgacccggtaaaaactcgattgaaaagtaataaacctgtttggtctcttcttgatcataccgcttcttggtgtcagcccaaggttgggcaatgtatgtccgcgtcaacaaggccaatgcctgataaagctgttgtgaagataggtcttcaagcggtgccgcatacattttcaaggccatgtctttaaagtctgcgatgaattgttcctttgttaatgccatcaaatatacacctcatcaaaattaaaccatcgcaaccattttggcgaacatgaacaacgaggtctcatcgaatgtccgatccgcagctaagacgaaatgccgtcttgtcggctgcgactttcattcgacatgacctcgcgatgacactcatgctttacctaggatgcgattataccccttcaagtaagccgccgccgaatgatgccaatcaaagtccattgccatagcctgttgttgcaggcgggcataaacttttggctcatcggaataaacgtgcttcgccatgcacagaatcttggccaacacgccggcattgtaatcccagaaactaaaaccggtgccagcgccagtttcggcattgtatggcgtgacagaatcacgcaggcccccggtttcatgcacaatcggtaacgtaccataacgcatcgccatcatctgcgccaatccgcttggctcaaacgcgcttggcatcatgaagtaatcagccccagcataaattcgttgcgccaacgcttcatcaaaatcaattcgaaccgccagttgccctgggaaacgatcttgcaacgacagaagatcctcttccaagtcgcgatcgccggtaccgaggattacgacctggacgttattttgaaccaggaagttttctaaggcatcaacgagcaaatcggcccctttttgccgggtcagccgactcaccatcgcaaaaagcggatccgaacgtttcggcagatgcatttcttcttgcaaaacgcgtttgtctttcgctttgccttttaaatccttggcactgtagttatacgtcaaatgcgggtcggttgccggattgtagacttcatcatcaatgccgttcaagatcccgactaatttaccactttgtttgcgtaaagtgccatccaaatgctcgccaaatgctggtgattgaatctcctgagcataactagggctaacggtcgaaaccagatcagcaaagttaatcccgccttttagccagttcaccgagccgtcctgggcaaagccgtcatcattaaagctttgccgcccgataccaaacaccgtgtccagaatcgacggcggaaaccacccttgaaattgcagattatgaatggttagctgcgttttaatcgcttgataaggttgaatccagccatatttttctttcaatagcaccggaatgaacgctgtgtgccagtcattggcatgaatgatatcgggaatccactcaatcacctgcagcatttcaatcacggccatttggaaaaagccaaaccgaccgccgtcatcccaataaccgtataagccgtcacgatcaaaatattgtcggttatcaatcagataataggtgacatcgcctagtttaattgttttaaggccgacataaaccggttgtccgcctatttcaatcgtaaaatgggtcagatttttgactttaggcaaatacttcgctggaaatttgcgttcgtaaaaaggaattgccacccgaatgtcaacgccttgtttcttaatggctttaggcaatgcataggtaacatcgcctaagcccccggttttataaaacggcgcgctttcggctgcggtaaaaagtactttaagcacgggccgtcaccccctggccatctggttgaaagactttctgattcttggcaaacactaatggttcttccggtgtgccttccaaagccagattcggtccaatgataacacctttgtctaaaattgcgtatttcacgctggaaccggtcccgatcttggtgccttgcatcacaatactgtgatccaccaaggcatcgcgatgaatatgcacattccggaaaagaatcgaatgattgacttctccttcaataaaatcaccggtccctaacaaactgttggcaacatgggattcggttgagaaaaatgtcgggatttcgttcttattcttggtttcaatcgagttagcactatataacaaggcttggtagttttggtcttctaacatgctcatgttggcgtcaaagtaacgcttgatcgtattgagtttggccaaaaagccggtatattcaaacgcgttggcattgttttgcaaaaccgcttcccgcataatctgtggcagacgtttaaaagtcggcgcttccgaagaatcggtgagcaaatcaatcaagtcaatcgtgccgatcaggtaaatatccatgaacgccggaatcttgccttctttaaggtggccccgattctccgcggccggaacaaccgagcttgcggttcccaattcggtcatatccaaagtcaggtcttccggttgcatggcggcttccggcagattcttatacaccgccgttaccggactttcaccagcttgatggtatgccacaatcgcatcaatatcgacattggcgacattttgggttcccatgataatggtatattgagcgctgcttttacgcagaaactgaagataatcgtcaaaataccgtgcccgcagctgcggatcttcataatcgcggccagccatgtacggatacgtgaaaacaccacctgttatctggtccatattccaggttgagccgctgcggatatgatccgtgacactgcgacccgacttgggcaggaaaatcgccacactgcggacatttgcatgatccaatgacgacagcggaaaatcaatgagacgataacgcccagcaaatggcagcgttccaatcgggcgggctgctgtcaatggctgaatttggtcatctttttcattcagatcaatgattgctgctaaatcgccttttctcattctttttcagtccttcctagaacttccccataaccaacaacactaatttcgtccggtttgccaatcaccttaccgttatcaccgatgatcgcattctcaccaacaatcgcatgatccacagtgacattcttgccgatcacggcgtttggcatgatcatgctgtctttgatcacggaaccttcgccaatcttgacattctggctcaggatactgtgctcaatggcaccggcaacatagcagccatccacaatcatggagcctgatacttttgcggtcttggttaaaaacattggcggcaaagcttcattttggctgaaaatccgccagttgcgattgccgatgttcaatggattattcggattcaagaattccatgttggcttcccacagactctgaatcgtcccgacatctttccaataaccacggaacgcatacgcatagctggcttcgttatgggtcaggtaggctgggatgacatcgtgcccaaagtcttccatcgccccatcagtcgcatagctttcagtcaaatactgtttaagggttggccagttgaaaatgtaaatccccattgaagccaagttgctcttaggcttagctggcttttcttcaaattcgataatccgatccgtgtcatcggtgttcataattccaaaccgcttggcttcgtctttggcaaccggcataaccgccacggtcaatgaggcttttttggccttgtggtaatccaacatggcctgataatccattttataaatatgatcaccggatagaatcagtagatattgcggattataagaatcgatatacgcaatattttgataaatcgcgtgcgctgtaccttcaaagaacttttcgccttcacttgacgcgtatggctgcagaatcgtaaccccggcgccacgctcgttgagtccccagctcgccccgttttgaatatgccgattcaattcaagcggttgatactgggtaatgacacctgccgtattcacccctgaattagccaagttacttaaggtgaaatcaataatccgatagcgacctccaaaaggtaccgagggcttggcagtggttttggttagtttacccaaccgtgtgccttgacccccagcgagaatgatacctaacatttcagtactcatgatgacggcgcaacttgcgccttcccccctcacttcttcttatgcttcttaacaatcaggtcttttttcaccggttgcgttcgggcaggcgccgtcccccaatcgcgttgatgactgatggccggtcgttcctgatttgaaattgccagtggcggctgctttccggaaagtgcggctggccgctgatggtgcttggtcgccaactttttaggcaacggctgcagttttttgggaacaattagtaacgcgcccattgctggcaaaatcacatctaaccaagccggctcgccgtattgatcacctagctgggcggttaaagtcgcctgccacttggtccaggtaccgccaaaatcaaggctttccgtatttaaaagaatcgtgtacgtgcccaagcttgggactggcacgcggaagtggtctttttgcaccgggacaaaatttaacgcaaccaccgtgaagtcatctttttgcttgccataacggatgtaactcatgacatccggttcatccgccattgtgatcttaatgccaagtggttcatgatcctgttgccaaagactcggtcggtttgtatagatatgattcagcgttttcgtaaaggtttgcattttatggttcatcgggtctttcaaatcaacccactcaagctcgctccagtcacgccattcaaggaattgaccccattcactgcccatgaataatagctttttccccggaaacgtcatttgccacacgtacatggtgcgtagattggcaaactggttgtaccgatcgccaggcatcttgtgcatcaggctcttcttcccgtgaacgacttcatcgtgggaaaacggtaaaacgaactgttcgttatacatatacataaatgaaaacgtcaataaattcatatcactgtggcgataaaccggatcttcttcaaagaacttcagcgtatcgttcatccagcccatgttccatttgtaattgaaccctaggccaccgatattaatcggcgctgacaccttaggataggctgaactttcctccgccatcatcaaaacatccggatgcttggcaaacaccttcgtattcagctgcttcaaaaaggcaatgccctcaagattatcgcggccgccaaaccgattgcgatcattttctttgccggcgtcataatccatgtacagcatattcgaaaccgcatcaacacgcagcccatcaagatgacaatgatcaagccaatacatcgcgctggaaatcagaaaactttgcacttgtgctttgcctaaatcaaaattccaggttccccagcgaacattttcggcgcggtgcggatcggtatattcaaacgttggggtaccatcgaattgagcgagcatatcggtatttttaatgaaatgtcctggcacccaatccatgatgatgcccaacccggccacatgagcagcatcgacaaacctgaggaaatctgccgggtcgccaaaacggcttgtcggggcaaagtaacccatcagctgatagccccatgaagcgtcaagcggatgctccatcaacggcaaaaactcaatatgggtataccccaattccttaacgtaaggaatcagcttatcaatcgcatcttgataggtcatatacccgccatccggaccggcgtgcgtgtcgcggataaaagaacctaaatgcacctcataaattgccaggggctcagcatatggccgccacttactgcgtttgcttagccacgaatcgtcatgccatttgattcgcggaatatcaagcagtcgggcagcactgcctggcttacgttcaaatccaaacccatatggatcaatcttttcatgtgtggccccatccggaccgaccaccttgtacttatacaactgtcctttctgggctgcgagttcgccgtaccaacagccggtttctccttgccgggtcagcggactgccgcgccaatcgttaaaatcgccgacaactttaatctgttgggcatgtggcgcccagacgagaaacgaccatttgccaggtgaaacttcatgggcaccaaaccgattgtaactttgaaaatcctgccctgagttgaagaggtataaccaatcttttaatccttggatcatgatcactcccccaatcacatcatccgactcgttgcatgtggttcaagcatcacgaatatttccttccgccacaagtgtaacagcacgaccatgaaaaggctcaagaaacgctcaccggatcactttttttaaatctgaccactcttgctgccaagaggaatataatcctcctcgccgttaattgtaaccgctttcggaaaatattaacagtaaatacaatttttttggttgagttatttgtgagaataatctaacatataggctatattatttaatgaaaacacaatgttttctaaaccgatctcgggatttgtcaatcttgtgttttaacccacgcaaccacccactggagggatgacgatgagcgtcgatattgattggaacaatctaggatttgattacatgcaactgccttatcggtatgttgcccactggaaagatggcgcttgggatgacggcactttatcaagtgatcccaacttaactttgaatgaaggttcgccaattttacattatgggcaaggtgcttttgaaggactcaaggcttatcgcaccaaatcaggaggcattcagcttttccgtccggatcaaaatgcccaccgtctgcacaactcagcagaaaaacttttaatgccaccgtttcctgaagatcgcttcattgaggcggtcaaacaagtcgttgccgctaaccatgaatacgtaccgccatatggcaccggcgcaactttatacttacgtcccatgttaattggcgttggccctaatattggcgttgcccccgccaaagaatatatctttgatgttttcgcgatgccggttggtccttattttaaaggcggcatggtgccaaccaagtttgtggtggccgatcaacatgaccgtgctgctcactacggcaccggtcaggctaaagtcggtggtaactatgcggcctcgctacaagccggaaagtttgcccatgaacatggttatggcgatgcgatttaccttgacccgatcgaacataaatatattgaagaagtgggttcagctaactttttcggtatctctaaggacggtaaaacccttaaaacaccgaaatccccttcgattctgccaagtattaccaaatactcaatcttggcgctggcacatgatcgcttcggcatgaaaaccgaagaaaccaagattgccattaccgatttagaccagtttggtgaagcaggcgcgtgcggaactgcagcggtcattacgcctatcgccagcatcacatacaacgatcacgaacatgtcttttattccgaaaccgaagtcggcccacatactcaggcgatttataacgaactcacgggtattcagtttggcgacgtccctgcaccagacggctggattgtcaatgtacccgttgattaaagcaaacgtcacgcaccgatttcaaactgcaaattaaaagcagctgtcaacgcatcttcatgcgctggcagctgcttttgtattgccattgatatcgcgatctttcttctaaaactcatccaaacaaactgacgattttgattcacacctgttagcgagcaaaggcaattaagcgccaataatcaccaacacaagtctggagcgtaatgcgctgaccgccacctgtaccggtaatttcattccaaagatcctgaccgtcagctgtaacggcttcaggcgaaacctgaactaaccgataaacgtgatacgtgcgcggacttccggcggcatcggtcaccgtaattggcgaaccgataccaagcgaaagcatcgcagcaaacgctccgggattatgcccgataaagtgcgtattctgcccactgacgttgctgtagtttgcctgaccgccccaagttgcggcaccgttcattggcgcggcgtccatactttcattaccaataatgtacggaacggtgaccccggcaaacattaatacccgactcgcataagctgctgccggtttcgccggttgtgcttgcggctgagcggttggttgagttgctgattggttcgtgacggctgatgcggttttagctggtgccgctgcaacagtaaattgcgcggttgatgtgccagcggttgcggttccggctgacgcatttgaagcggatgcagcggaacttgttgatgaagcggtctgattggttgccggcgcgctaacagcacttggttgacttacttttgtctggccggatggtgttgggtcagacgatttaacgactgcttgacctgagcgaacactccaactaggatgcgctgccgcctgaactttttctggcgtcaccgcagcggttgctctgagtaaatcgctcgatgtgcttacatcattagctttctcccttgtgctggtgcgcaatccggccaagtctcggctctgaattgtatgactgactgtggtcgtaccaaacagcccgcccaatacaagagcgaaagtgatcagacttctgcgaaacatatagactcccccagtccatattgcaaaatgacttaccacactattaacttcgagatggccatctcttgatttagattatgcacaatttaatgaagcaggtaaacaaatatgcttacttttaaaaagtagattttgttatttataatcaggataatacttgatgataagcagtttccgttttttaaaaccaaattatcaaaggaatctttttaaaagttggtttacagcattttataaatatcgttatttttaggccttgatcagcgcgcttatccccgtcatttcaacaaaaaagcccagtgaacaaaacacgtcactgagcaatttatcatgatggttaacctttaaaaattcgaaaaaccgattagcagctcaaatactaccaccatgaacttcagtcgcagctacggtcagaataaaggcgtcgggatcaataccatgaatcagttcaatcaggtgccggaaatcgctttgctcaacgacgaccatcaacatctccctgttttcatctgaaaagccgccgacaaccggttgcaccgttaaaccgtgcggcgtttcgtcgcgaatccgctgtttcaacatatccagttgatcgctcatgatgtaaacggcttttttacggtcaaagccggtttcgacataattcatgaccagactcgtaatcgtgagtgcaaatacggcaagaataaaggcctcaacacctgacaccggaatattgaagagcgaaacgatgacatccgtgatcagtaacataatagacggcttcaagccaaaatatttcttgaaaattagcggcggtaccgtcgttccaccgctggaagcatccatttggtaaagcaatccgaccccaaaagcaaataccacactaccgacaataatggccaatagccgatcggtcacaaggttaatctcaggcgtgatccacaaaagtaatggcagcatgaaactgccgaaaagaatgcgttttaaggtgctgcgatcgaggaaaaaccatgctagccctagcatcagcagattaacagccatggtggttaagccaacttgaatcccggccacttcctgaaccagaatcgcgatcccggttgcgccaccagcagccactgcatgcggggcgtaaaacatattgatactcaccgcaataagcgcaagcgccgccatgatccacagccatttcagcaccggatgtcgcatcgttttttgcatcaagccaccctttctatggttatccatgtttctaacttattatgttaataactatacgggataaaatgcttgctgacaaacaacgctcattttaaaaccgtggttagtcaccattgcgtaactcagcaaggcgccgttttaacacctccacctcagcctgtagcgcggtgccaatatcggtttctgccacggtgcggcgccgtgcctccgtttcaacaactcggcgcgtggaaataatgtcggttaaattggcaatcgcatcggccttggttgtaaacggctgatgggtgaccagctgcatgccatacgaattatccaacaaagtatacccgccaataccggttgtcttttggtaaggctttgaaaatccgccgtcaatgacaatcattttgttattcgccatgattggatcggttccttttttaaccggcgtatgaccattaatcacgtgaccgacttccggatcaagcacaaactcacgcagaatttttttgatgaaatcaggatccttgcgcaagtgataataagcattacggccttctgcatgcgtcgcgggatccttgataaagtaccgctcaaatgtggtcatgtcgtgcttgccaaaaagcggcgaattcggaccggtccacagataccatagcaaatcagtcgccaagtctgctttttccgtgggctgactgtaggcgaggcgcaaattggcttccagcatgtcaaacaactgccggcctgtataagtcgtgccttcaatcgttaaaccaatgaaattgccatcttcatcaaccggcacgcacccgtgtaacagcaaattgcgattataccgcagatacatactgccgcgatccatcaaaaaatccatatggcgatgcaacttttccgaatgggtgaacgactcgactaaggaatcaatgacctcctgctcttccggcaacagtcggtaaggatcagccgggtcaaccgtcgcaaaacagccattggtgatgggataagtatgcccattcaactgaatcgtggaaaaatccgcggctaacttgtccagcaataaccgatgatccatttcaaattcaggacgccgcttgatggccgggccttcaagtttgaactgaatcatggcaattgcctgatgaatctgggtgatttgtaaccgttccgcctcggtaattggccgatccgagcgccccattttaggcgaaaaggccggattatcctgataatattgttccgccaagcgtgctaaatggcgcaaattaatcccataaacatcttcaagaatgctcaggttgttgtaccgggctgaaatccgcaccagattggcaatacacaacgccgaaccagctgcaccgccgatccataaaatatcatgattgccccactgaatatccaccgaatgtcgctgatcacgcttgatcaaactctcaaccacctgatccggcgccggcccccgatcataaatatcacccacaatgtgaaaatgatcgaccgtcagccgctgaattgtccgacacgtcgcctcaatccactcatcggcctgctccaaaacaatcaagttgcgaataatctgccaataataagccagcttatcaggcgtgtccgcatcgttatacagcagctcttcggtaatataaacaaactccggcgccatcgccttacgcactttcgaacgggtatatttagtcgcggtaaacgccagcaagcgaatcaaccggcgaaaagtggtcagataccactgctgcaaatcatccccttgcagctcctgatgaatcgcagtcaaccgttccgacgggtaatacaccaaaaaagcaaaccgctgcaaagtcgtctcggtcatctcatcccgaaaacatgaacgtatcttgctcttcacattaccgctgccattgcgcagaacatgctgaaacgcattatattccccgtgaatatcgctcataaacgcctctgttggcttgggcaggttcaaaatcgcctccaagttgatgatctcggtggcaatggccggaaccgtttgatacttggccgtcaattcactgtacaaatccatgatgcagctccctttcgcatagaccaatttttgactcatggcaatatgatagcataattccggcttttgtatacggtttcaacatttttcaagaaaatcataaatagtggctggtgatttaggttgcggtttctggccgaatttcagtcactttatagttgatttgataatgcaggccaccctgttcgaccacaatagaaattggtacagaaaaaagcttaaggaggaggtcgatatttgccaatgcaatcgcgctatccaccgttaccaccaaggactcagccgttctggtgttcactaagtcaagcccaagtgaacctttcaagaaggcaaacttgcgctcaatggcaccccgacgattttccgcactgacatcggctttgcgctgtttcggatccacatgtttgggctttcgacccagctttggcccattaagtttaatgcctagcttcttacacagattgatgttatctcgcgtgcgatagagagtatcgaccagcacctcatccggatattcacccactaggtcaaaagcatggtcaagcgttacttcaagatcagtgctttcgttaaatgaattgaagtcgaaacgctctacatcaatcacgccatccaacatggaacagtcaatcttggcgccaaactcaacggactgctttgccttacctcgcacgattggccggatatacggctgttgaaggctaacgatgcgattctcgacatggtgagtgtggttctcaaacatgaagagctgctgctcatagacttgtttaatcacttccagacgctgtgcttgccaatcagtgagctgaccgccttgcgcaagcagttccgccacatatcgcagatctcttcggatgtattgtagctgagcttgaagctgtttgcggcgttccttgttttgacgccgcggtttcctcgaaaaagcggtccacttaccttttgcttcacgtctgtatgtccgcggaatttccacacctaacccgtgggccagatctgtgaccatttgttcgagattcaaacgactctggttaagcagcgttgtatcttggggatacttgatcttgaccggaacggcagtcgcatcactaatcaaaacatgcgtcccctcaggtagatcggcctccaaccgctcgcgcgtgaagtcattagtaatgttgcggatcaaatctgagatggctgaaagccgttggcgaaagtgcaccaacgttgtgtgttcaaatggcttcttagcgcgatattcgggtaatccgatgaagtactgataggctggtgtatcacggatatcgtcgacaacttggcggtcggtcaggcctttcttcaacttgatcaacgttgcgccataaagcaatcgaaatggcttcgctgctcggccggtttttgaagggaactgtaattggtatgcctcttcaagtttggcccatgggatcaattctgcatattgaacccactcgttgtccgggctgagcggtgttcccagagcgcttccaaaggattcaagtgacagttgcgttgctttttgacgataaaccatgatcaattcctccgataggtcagcgataagtgcaagggtaaatcccaaagcataggcatttcgggcaaatgaggcttgcacttattatacgcttaactattggtaaagcctattatgaaaacacttttagagtttttcaccattcactaaatatctgctaaccctcagcgtgctttgcaacttgatggacgcacaagttggcgctgcagttctgccatagcgggtcaaaactataccaactaaaattcctgttggctgtgattcacgccataaaaaaagccaccatcaacgatattctgtatcgttaatgatggtcaagcaccgcacgtgacgctggttggtacacttcacacactcgatgtatttaacaaagccgtccaaagcttttgccgccggacttcacgtggtaaaaagacccggacagagtcttgattaaacccaaacaacagtcggcgttcatccacaatgatcggacggcgcaggatagccggtttttctgccaacaaatcaaccgcctgctttagtgatagcgcatcgaaatcaatgtcaagtgcctgaaatgccttagatcggcgcgagactaaactatcaacgccatcctccgaccgcgccaagagctcaagaatctgctccttgctgataccttgctttgacaacgaaatttcctgaaatggcaacccattggcttctaaccatgcccgagcctctcgacttgatttcgaagaacccgacgtatacaacttaatcatccaatcacccctcgcagaaacaacagtatatttctatcgtttcctagctaataccacccacatgctcgttgctaacaacattcactggcttatattgattcacccaggacacttttttattatcttaatgataacttaacataacgagactcgcatgacaataaataagcgtttgcaccatcaccactctggttatgactcatcaatatcaagccaaagcacatctagcagttaagtgatgaacggttattataaaacttaagtctcgccatcaataaataacagcatttacagccaaattaagccaatataagtttgtgaatttttagcataaaatctgatacatcagtttcatatcagcggttggttctctttaaatttagcacaagctcataccgctttcaataacaatttttgaaaaattaattttcgattactaatattcaaatattttcaccataatctgacatataaaatactggcgataaattgtcttttaataagccttcatgctgatcgttctaaaagttgtgggcaaaacagacgggcgcaatttatttcaaattttattatactactttttcaaagcaaaaaaagcggccgccaaacgatttttctcgcttgacggccgctgtgcgcattacttcgcaccgctagcttctttctttggcttgtcgcttgctggttgcacttcactgacgataatcgcaccatcaatcaagtcagcctgtaacttcttagccttcaggtgatccaggtagaagtcggtaaccttatcgcggatgttgcgttcaatgacccgccgtaatggtcgtgcacccatcgcttcatcgtaaccttgggcaatcaaccaatccttggctgcatccgtcacggtaagtgtgatgcctttcttcgccaaagtcttgttgacgtcttcaagcatcaagtcaacgatcttacccaaatcattcttggttaagtgactgaattcaacaatcccgttaaatcggttcaggaattcaggacggaagtaaggcgccaaccgcttcatcaaatcttcgtccttctccttctcgccagttaatgcttcattgccaaacccagcattggaagtggcaatgatgacggtgttcttaaagtcaacgacattaccttggccatctgttaaccgcccatcgtctaagacttgcagcaacagcgtcaagacttgtggatcagccttttcgatttcatcgagtaagacgatggaataaggattgcgccgtacttgctctgtcaacgtgttcttgttgtcattgtatccaacatagcctgcgctggtgccaatcagtttggataccgctgtacgatcgctatattcggacatatctaaccggatgatcgcatctttactgccgaaaagatctaacgccaactgcttagccagttcggtcttcccgacaccggttggtccaacaaacaggaagctgccaattgggcggttaccttcatcaaagccagcccggttccggcgaatagcgcgggcaaccatatcaacggcttcgtcttggccaattaccttacccttcaggcgcttaccaatgcctttcagccgttcaatatcggatgcacccagcttggaaaccggaatgccagtcaaacgttcaacagctgcagcgacatcattcggggttgcgacgacaggcttctcgttgttcgttccttcaagctgatgttgcttgtcggcaatctccttcttaaggttggcagctttttcaaaatcttcagcttttgccgctgcatccttttgcgcgttgagatccttgatttgcttttccagttccaccttgtcaacaatcgggtgcttgcttgctaagtgtgccgcggtcatatcaatgaggtcaattgctttatccggcaaggagcgctgtggaatatattgaatactataatccaccgccgccttcaaaacattttccggtaactgaacgtgatgatgctgttcgtaaagcttcttgacgccttccagaatcttgaccgtatcggcagcgctcggttcattgattgtgacatcgttaaaccgacgtgccaaggcgctgtccttcataatggtattgcgatattcatcttgcgtcgtcgcaccgatcacagtgatttcaccacgcgacaaggctggcttgataatatccgcgaggcccttaccgccagactcttcgccaccagttgcaccggcgccaagaatttgatggatttcatcaaagaacagaagcacattgccagcagctttcacttctttgatcagattctgaatcttttcttcaaagctgccacgatattgcgtgcctgcttccagattcgacagatcaatcgaccaaatctgcttgtctttaattgattcaggtacattgcccttcacaatcgcttgtgccaagccttcaaccaccgcggtcttgccgacaccggcgtcaccgaccaaaattggattgttcttcgtccgtcgactcaaaatttcggcagtttcctgaatttcgtgatcacggccaatcaccggatcaagcagaccatccttggcttcttgcgtcaggttgcggccaagcttttcaagaataccgcctttcttaaccgcttgttcgccagtcgtttcaaccgggatttcatcgccttgctttggcagctgaccagtcgcccgatactgcgcaaattcatccggcgtcatttcgtggccattcaccacatagcgggctgactcgcctttacccattccttgaagcatctgattgaatacatcgtccatgtcatgattgaaaaacggatcgttaaagtttgccatagtcgaattcctccttgttgggaatatgcggggaaaaggcggtggtggcggggagcttattaggatgcacaagatcttgctgctttcctaaacgcgttcgcagggccagaaacctgcgtgtaagggccttggatgcactggtcaaaacccgaccagcacatccaaggccacttacactccggtttctaagcggccctgttcacgctctacaaaaaagcactcccaggcgctctggcagtactttcgtgtcgtgcttattcacttgttggcacttatactgttgcgccttttccttgtttacataatgtattatagcatgaaattagcactcacgcaacccgagtgctaattttttctcacgctaagtcaatcaaggcgtttctcagttgattaataccgcgacaacaaacgcttttcaaccttacgctcattaaaccggactaacggatccccattaaccaaggcgcgagcattttcctcaaaaattcgggctttcttttcgccacgcttacgagtcaaccgcttgaacgctgcactcatctcataactgcgacccggtaagtgatgggcatcagaggcaaagacatgtgctaaccccgcatcgataatgtcttcggaaaattgttgtacctttttcccaaatgtgcccacatagctgctagccgtcacctgtgcaaaggccccacgttcaaccatctgataaagcaaaccgggatgcttcatcagtcgggtattccgctcaggatggacaatgaccggaatcatgccacgctgcatcacttcaaacaacatattttgggtataaagcggcacatcgtcagacggaaattcaattaacacataatgcccgctcacgtcacaagtcagaatatcgttatggtcaattgcttctaacaactgaccgttaatccgcacttcctgacacgggaaaaccgttagtggaatattgcggcggtctaactcgtcttgaaactcatccgtcatccgaatcacgtcagccgcatgattcgtataccgtccattcatatggtgcggcgtcatcaacgcatgcgtaatcccatcagccaccgccgcctgtgccaattcaagcgacgtggttaagtcttttgaaccatcatcaattcccggtaacatatggcaatgcacatcaatcatcattcagttccccttccaatactatctagtatctaatgaagcgctcccaaggtcaaatttttttgtaacagtttgttaacgtttcacaatagatcagcgagctggcagactttgcggtataatatgcaaagattacggaggaaatgaggtttaaagatgaaaaagatcctagtacgcgttctactcgtcgtactcgttgctgcgctggggtttggcggcttcgtgtactacatggttcacaactcgacatcgcaaatatattcctataataagaagacaaacaaatcttccgatgataaaaccaccagcaaaaagccggtcgcatacttactgctcggtacagacacaggcgaacttggccgctcctacaaaggccgtaccgacaccatgatcgtgatggtactcaaccccaaatcaaaaacaaccaccatggtctcagtcccacgtgacaccaaagtcgattttgatgacgtcacaatcaaaatcaacgcagcctattcttacggttcctccgacaccgccatggaagccgttgagaagctgttaaacatcaaattggatggttacctgctcgtcaacatgaaaggcctagaacagatggtagatgccgttggtggcgtgacagtaacctcgccattaagctttgactatgaaggcaaatcatttgttaaaggtcagtcatacaatttgagcggcagtgatgccttgaagttctcgcggatgcggtatgacgatcctcaaggagattatggccgtcagatgcggcaacagcttattttgacgtcggttatcggtaagcttaagaagaatccaacgactgtgttgagtcaaagcttcttagacgctgttggtaaaaacgttcgtaccgatgtctccctaggatcagttaaaaacctggcaatggattatcgtgatgccgggaataccattaagagtgatcagctacatggcacaggccagaacattgatggacaagattatgaagttatgtctgattctgaacttactcgggtgcatgatgtgattcagaatgcgttgaacgcaaaataagaaaacagataataaatggaaccaccatgaattgatcaaatttcaaatcaattcatggtggttcctttatttctcgggtaattgaagttaagttcaacttattgactgttcttcttgtacttcgcttcaaccgcagatttttcatcttgccaccaactgcgatggtcggtgtaccacttaatggtgtccgccaagccttcttcaaagtcggtatattgcggcttccaccctaactcttcgcgggtcttggaggcgtcaatggcataacgcatatcatggcctgggcgatctttgacctgatcataatagtcagtcggttttcccatgagcttcaagatcaattcgagcacggtcttgttatcctgttcgccattagccccgattaagtaagtttcgccaatcttgcctttagtcaaaatgtcccagatggcgctggaatgatcattggtgtgaatccagtcacggacattcttacccgttccgtaaagcttaggtttaatgccactcaaaatattggtgatttgtcgcggaatgaatttttcaatatgttgataggggccatagttattggagcaattagagatggtcgcccgaacgccaaaggaacgtgcccatgcatgaacaagcatgtcactggccgctttggttgaagaataagggcttgacgggttgtagcgactgttgatcgtgaacttttcaccgggtccttcaccatggccaggaagatcttcacgtaacggtaaatcaccataaacttcatcggttgagatgtggtggaagcgaacatcatacttacgggccgcttccaacaaagtataggtgccaatcacgttactgtgtaagaacggatccggattaatcagtgagttatcattatgactttcagccgcaaagttaaccaccgtgtccacttgacccatcaattgatcgaccagttctttgtccgcaatatcgccaacgactaacttaacccgatcgcccaaaacgtcttcgatattggctttattgccggcataggtcagcttatccaagaccatgatctgaacatctggatggtgctgataaacaaaatggacaaagtttgagccgataaagccggccccgcctgtaatcataagtttcatgtttaaatctccccgtaaataaagttattctcggcatcttttaattgcggatgatgctgatctttttccgacataatcagatgtgccgttgacatcggccagtcaatcccaatatctgggtcatcaaaggcaatcccacgatcagcttcaggggcataataaccttccactttataaacaaagttaacgttcggcgttaaggtaatgaagccatgcgcaaatcccttaggaaccaagagttggcgatgattatattggctcaaaatataaccttcccattgtccatatgttggcgagcctttgcgaatatccaccaaaacatcctcaacgaccccagtcaccacgcgcaccagcttcgtctgcgcataaggcgccatttgataatgcatcccgcgtaagaccccggcttcggccgacagtgattgattgtcttggttgaaatcgtttttgattccggcttcgatgaacttttcccgggtatacgtctctgtgaaaaagccgcgattgtcgccgaatacatcggtttcaactaacttaacgtcctttaatttggttggaataacttttaaactcaagtgtctttgcctcctaggcttcttcatctgccaagcgcaaaatgtactggccgtaatcgttcttcttaagtggctgcgcgagttcgcgtaattgatcgcgatcaatgtaacccattcggtaggctacttcttccagacaggcaattttaagattctgtcgcttctgaacggtctcaataaaactagccgcctcatgtaaggattcatgagtgccagtatctaaccaagcaaatcctcgacccaaaagctcaacgtcaagttggccacgttcgagatacgctttgttcacatccgtaatctctagttcgcctcgtggtgacggtttgagattcttagcaatgtccaccacttggttgtcatagaaatacatgccggtaaccgcaaagttactctccggatgctctggcttttcgacaatcgattgcacatgatgctgctcatcaaaagcgactaccccaaaacgttcaggatcgttgacttgatagccgaacaccgttgccccggtcgttttagccgccgagcgttgaaccagcttggacaagccgctgccataaaagatattgtcaccgagaatcaagcacacggaatcatcgccaatgaagtcagccccgacaatgaaagcttccgccaggccatttggcttttcctgtactttgtaactagtgcctggtgatttaggctgcggtttctggccgaatttcagtcactttatagttgatttgataatgcaggccaccctgttcgaccacaatagaaattggtacagaaaaaagcttaaggaggaggtcgatatttgccaatgcaatcgcgctatccaccgttaccaccaaggactcagccgttctggtgttcactaagtcaagcccaagtgaacctttcaagaaggcaaacttgcgctcaatggcaccccgacgattttccgcactgacatcggctttgcgctgtttcggatccacatgtttgggctttcgacccagctttggcccattaagtttaatgcctagcttcttacacagattgatgttatctcgcgtgcgatagagagtatcgaccagcacctcatccggatattcacccactaggtcaaaagcatggtcaagcgttacttcaagatcagtgctttcgttaaatgaattgaagtcgaaacgctctacatcaatcacgccatccaacatggaacagtcaatcttggcgccaaactcaacggactgctttgccttacctcgcacgattggccggatatacggctgttgaaggctaacgatgcgattctcgacatggtgagtgtggttctcaaacatgaagagctgctgctcatagacttgtttaatcacttccagacgctgtgcttgccaatcagtgagctgaccgccttgcgcaagcagttccgccacatatcgcagatctcttcggatgtattgtagctgagcttgaagctgtttgcggcgttccttgttttgacgccgcggtttcctcgaaaaagcggtccacttaccttttgcttcacgtctgtatgtccgcggaatttccacacctaacccgtgggccagatctgtgaccatttgttcgagattcaaacgactctggttaagcagcgttgtatcttggggatacttgatcttgaccggaacggcagtcgcatcactaatcaaaacatgcgtcccctcaggtagatcggcctccaaccgctcgcgcgtgaagtcattagtaatgttgcggatcaaatctgagatggctgaaagccgttggcgaaagtgcaccaacgttgtgtgttcaaatggcttcttagcgcgatattcgggtaacccgatgaagtactgataggctggtgtatcacggatatcgtcgacaacttggcggtcggtcaggcctttcttcaacttgatcaacgttgcgccataaagcaatcgaaatggcttcgctgctcggccggtttttgaaggaaactgtaattggtatgcctcttcaagtttggcccatgggatcaattctgcatattgaacccactcgttgtccgggctgagcggtgttcccagagcgcttccaaaggattcaagtgacagttgcgttgctttttgacgataaaccatgatcaattcctccgataggtcagcgataagtgcaagggtaaatcccaaagcataggcatttcgggcaaataagggttgcacttattatacgccgaactattggtaaatcctattattaaagtacttttatagtttttcaccatccactaactaatattgagtcccagttgtttaccgtcttttaacagatcctgaaaacgatcaatatcccttggtgttgaaatcaccaagatatcgcgaatcccggccaacatcatggttgacaggggatagtagatcattggcttgtcatagaccggtaccagttgcttagaaacagcttctgtaattggatacaatcttgtaccagagcccccagctaagataattcctttcattgcattttctcccctcgcgtagtttagtatgtagtgtttctaaagtttaagcaaaccctaacactaagcattttaccagtagaactttaaattgtgttgctttttatagaattgtatattagtttgttaatttattagttcacgagatccacttttaacaacttttcaagttaatacttagacgttgtaaattcaggaatttcaggcaagatcaattaactgtgaaagtctttttattggttgaaagagctccttcttttccgaaattcaaattaggcaatgcgatcaagtgtgcattcaagcgtgattattttaagcttcatgcctttaccctagatcaacggacttaatttccgcaagtatattcaatactactgatctactgaatcacccgctttttccgcccacagcgatgacaaggcattactggtttttttactaggttcgatgaggattcaggcaaactaattgcgaaaaagcagcctcaaaaaacaacggcttcgatattcctacagcataaagaatatcgaaaccgttttagatggaccttactatgtcaaaaaggcagattaaaacttctatgctacacgatgatagttaaaaagccccctcagccttaaagatagaagcaatatttttaaacaaaataatgagatcatagtggaaagatctgtgtcgaatataatatagctctaagtctgcacgttctggataaccaatgttacttcgaccactagcttgccataatcccatcgcaccaggctttgcctcaagtagttcattaacatgatcgccatactcagctaactcgtcttcaatgaccgggcgcgggccaaccatactcatatcacctttaaggatgttaataaactggggtaactcgtcaagtgaactctttcgaataaaagcccccaacctcgtaatacgtggatcctcaccaaccggtaatttgtaattatttgctacatacttcttataaagcgcagaatcccgatgcagtaccccttcagcatcgacaaccatacttcgaaacttataaattttgaatctatccccgtgtcgtccaacgcgcgtttgtttgaaaaaaaggggtcccttatttcgcccatacgaataaaacggaagtaagactaagctaactgcggcaactaaaactagaccagccaatccacaaaaaatatcgaagcttcttttttcaaataagtaaatcagtgaagcttgtttccgaatattagatatttcgttttcattatgcgtcgtcaacatctgtttttccaaatttaaattcctccccaaacgctaccccaagcgccaatttatttgattttataacattttttggcattgtacaagaaaacgtcaaatctaaagttaaacgttcaataccattcgagctagaccaatacaatgaaattagtttgtcaatccggcctatgcaagccacccgttaagatgccaggacccgcatctaagccaccctattcatgctaaaaagagactctcggattgaagacgagaatgactatgtcgctattcgcatagttaatattctaaactggtctaaccttggtgagaccaagaaacatcgatattagcattaattttgctcccatggtcggcgattcagatctcatcttgaacttctttgtgtaccaattttaattaaaagtcaaaggtagatgaaaatatataacctttgtatatgatttattttaaaataatagcagcaggttaattttgtctccttcaatcaagaccgcctttgcaactcctacacaaaagcatgaaaagaattaaaactattttaattgtcgttacacgattgtagagtaagctttgtaggtagagttggcagcgttcttatagctaaaaaaagaacgataatctttgccaacatgatcttttttattttgcatagctgataaaattgcctttttgacagaggaaagtctatacggattacactgaaaaccaaattcattgaatctataaaaatttattgggcaaaaatactctgttgatgtaacaacaggaatttcgcaaaaaagagcttcaatggtcgccaacccagctgattcttggaaggaaggcagaatatgcactgcagcatttgaataaacaaatgccatatcttgctgtgaaacttcaccaataaagtatgtgtttccgcgtttttttgcgtaagatttaacactttcgacataccggctatcacccttggtggatccaaccaaaacaattggaatttctggatgattgtttaatgccttcaaaatccgcaattgattcttgagttgctcaactcttgcaacacaaaggacatacttaccagaaagtctttccagaatttttaaattgtcaggaagctgtttaggttgttcattgactttaaaaaacttctttgcatctactgcattaggaataactccccattttttgttacttgtggtcgcatttggaaaggtcttcttgagaatggattcttcttcgggtgaattgggcaaaacaatatctgaatactgtaacaacttatcagcctttagaaataactctcgcgaaaagaaattcttcttttttaaaatatccctaaacaatagttttgacacaaacgttgccaacttaactactacttttggcgcatcaattatacctttccttgctaaagcaccattaataaatgattcatccagcctccagtatattggtgataatgcaatcttcatgccgagagctttggccatttcagcatatgcaagacttgaatctatagtctgcggttgcatgttaaatatatgcacaacatctaaacgtttctctttcagcttctcaggagatgtaacaatagtacaacgcgccccaaagtctgactcaagatatttcatagtgttcaacagttgaacactatcaccgccttttcgtgtgagaaaatccgatcgaaccgcaaatccgatatccataaattgctgtctccttaaaattgatttagttactcgacaattatattttttcgaatttagatcatcatttcaggtgggccttaggcgcaagcattaattctgatgacattcttgatctctaaagcacgtctggaatagttgttgaatatttcttacaagatgatcgaaccattttgaaatttctatgcgtcaaaaccaaccggtagactttccaacgcatccttcaacataccaccattacgaattttttgggagatgatttgaacattcgtttgaattttttctatctgtgtatgtgaaagtgacttaatgacaggttcaatttccatcagattatcaactgcgattcctaaccctagttgcagaacaacattggctaaagctgattctcgccaaacaatcaagggtaatccagaagctaagtacagtgatgccttgtgcggcgagtttaagcggagataatctcccgaaaccccactgatacgatcagtcgagattccatcccagaccaacccccagccatcaacaagcttggatggtaatacgccagagtcaatagcaccgtgaaaaacgaccgattctgggaattgctccgccgtcatacccgaaccataaacatgccacttaaaaatttccaactggggaagcttctttaaaaactttgactttactaaattgccagcaaaaactatatttgcgacttcgcttctaataggcggttcaacatcaactcgataatcaaaaaaattaatagtagccatcttctgagaaaggccttgatcttcaagaaaattttgcattgcttgattatggacaatcaaaaagtcagccctttttaattcttcgatttcctgtttaattgatacatttttagcctgtccttgaacagaaatgaggtcatgaacaagaaaaatacactttgcattatgctttaagagtgttttatgtaacaggctataatcaaaagaattaaaaggtaacggatattggataagaactgattggtctgccgacaatttctttgaaagactacgaactgctcgtagtcgttgaagttccctgtttatctttaaatttactcttgttgcaggtatctctgcagttttaattcccatcctattggagaagtatttgacatcggctcgtgctttaaagcctgcatcgaaacttttgctattgtacccgtcaaattcaatcatgattttcccactttcaaaaaacgtcgaaatactctctgataacaacatttataatatcaattattcaacatttgttgttaaaaataaataataaaacgatagagttccaaccaatgaggtcttttttgcccgatgtcttaataaccaactaaactttgacaaaaatctcttggatcgttgaatagaaatcaaagaatccaattctactttacggctcacagacaaatttttaccaaatcttgtatcaagtaattttatttgtgccatttgctttgaaaaaagcttcctctgattactatagtttaaagctttattaattcttgacctgaatgaatgatttaccccaacagcgttatccccatgctgacggtatccaatcgtggctgttggaagatacactacattacctaaaaatgctgctatcatagccatccaccagtcatgcatcacaattgagcgagtatcagacaaccttattctatcagctaaacttttgttgattagaactgtacaaccggtcacaatatttgtaactaagatggtgttgacagaaacccttgcattttcaggaacaatattcgattgaatcaaagtaccagatgcgtcaattgtatccatattagtaaatacgagcgttggtactgaagcactcgatgtttgctgcatatatgagccaaccgttagacctaccttattggggtaccaaatatcgtcttgatcagcaaacataaacaatggggcgctgatggaggtcaacatcattaagaaagaattggcagggccacgattacctgctgaatcgggaaaagaatgaattcggttatcttttagaacataatcatctataatctgctgtgtgctatccgtagaaccatcatcccgaattataagatcccagttctcataatcctgctgaacaattgagtccagttgttgttttagaaacctctcaccattatatgttgacatcaaaatcacaagatggtcaaaagtcattctgtattccctccctgtaaggcttccaacaggtgaagaacatgttcgcgcatatctaattgatcatatccgatttttttcattcgcttcgattcatcaactcgcacatgtttttcagttgcagtaatccttttgctccaggaatccgatgattcgctgagttttacaacatgaaccaaattcggtaaatagttacctagcgggactctatccgaaacataaactggtaaactatttgcctgagcttctatgagcgtaaagctcaacccttcattcaacgaaggaaagagtaaaacatcaattgcattatacagctgtgcgaggtcttttcttctccccaaaaatcgaacactatcacccaattcaagacgtctagctttttgtttcaacatttccctctgtgttccatcgccaatcactaacaatactgagtttggattacgccgaattatcgctgcaaatatgtctagagcaaagctaatattttttctcatttccagaacaccgattgtagcataaacaattttattttgaacatctaatgcttctcgaacttttactctagtggcgcgcttaaaagtatagtctgataagtcaatgccattcggtataacttcgactcgattttttctgagaattcgactaggaaacatccacttagctgcttcattagaaacagctacaaaagagtcgattagaaatgtagcggctatctgtttgccaataaggtgaaatactgtcaacgcaaacttcttcaccccatgtatttctgtaccaaaatacgtattatgaccatggacaacaattttcgcatgcattataaatttacagaaaaaaatcggcagtatattccaacttgcagaataattaaaataaacaatatcaaaagcatgcttatttcttcttgcaaattttaaccagtcttttatatgtcgaatatagttcttgttagccggagaaatatcggtaaaagtccatcctgctttttcaaaatgtaatttgttactttcatccccagcaattgcaagtgctgaaaaactgaacccttggcgctgttttaaaaaggcattttcaacgaaagtcgtaaccccactagccggcaagaagtctgcaacaactaaagttcttatcatagtttccagaccctccttatttatttcctattattggaaatatgcgtagttacgaacttacgtctgttaaacttattgaaaagaaaaccatagatttttctgatccaatgttggttttctgtaaacttgtaatcgcactctgtataaggaacttcatttgcctttagccagacatccaacaaaaattctgcaaggaacccatcaactctagtttcattgccttctagactattgaaatctaaaagttcatcaacttgatcaagaattgaaaataaccaattcgtataatcttggaagacttttttcttcataataaacatgttaaacatatgggctgatctggcatttaaaacctttctaaacgcgaatctataggcctcaggttgttcttccatcaccttctttaaacagtcaagtccttgacgatcgtgggagtgataaaagtgtgattctatagtctcaatgtaatagtgccgtttttttggaaccacaacatctgtatgagccattaatttttttatgtcagactgcttaattaagtcataagagcgacttccgaacttctttttattcacaaaaaatctgcgataatgcacaagcccaaggatatcaaaatcaagattgtacttagcccaataaatcgcagttaattcattataatgcgggtttttccatgaaatatttttccctgaatcatctcttagaaaacccttgggcgtcgattcatgaaatttgctcccaacataaacagggaaataagtttggtcatttggtacctgaacaggtttatgagcagctataataattttaatcagcaagttccccacccctctctgagccaaaaaagattatctttgtctaatactagacaccatttcaatcaagtgacgcggctttaaaagtaataagatcaaaatataaatgatcgtccctagcaaaatggttgttactagtttaaccatatttccaaacggcataaaatgcatataccaaaaaatatatgcacccatcaaactagcagaaagtaagtacttccaggtttccgtaaaaagtagagaaatatccatctgttttcttacataaacaagttgatatgcagtaacagcagcttctgaaataacggttgccgtcatggcaccgaccgttccccaaagtaaaatcataggaatattcaaaaaaatgtttacaattgcacctaatgcaacggaaaccgtaaaaggcctagtttgatttgtcggcagtagatattgtataccgatggcattactaattccaaccaaaataataacaagtgactctattgctagtagtacagcaactgcactgaacttgattccgaaaaaaacatttgtgaaaacaggagatatcgaagcgagtccagctgacataggaaaagctaacaacaatataaaatgcatggacttactaagggaggaaaaaacagccttacgatcccccctagcaaaactatgcgccacatgtggcaacaaaaccgttcctgtagctgtgacgatggctaacaatatttttataattttatctgagttgtcataataacctgcagcttcgaccccgatgtatgctcccagcatagtcttattcacttgcaaatatatctgtgaagcaatttgtggaataaacatcccaattgtaggcttcaagtgtcggccaagtctcatttttctcaagactggccactttacatatctagtaagataaggaatcagcgttaaattaccaattaactgtgatccgcccaaaatcaaaacataaatccataagtcattctttgttctaactaatgtaaaaatcaaaacaagtgaaataatttttacaaatgtatttcgtaccactgtaattctaaattcttccaaaccctgaaaaaaccacgaaacgtcaatcgctgaagctaacaacagtgaaccctgaatcaggtagaaaacacggtactgtttagacaaaaatataaaggtaagatacgcgataacggcgacgcccgttgtcaaaaattttaaaaaagttaactcccaaaaaacgttcgataatttttgagggtcatctctttcatatgcaacttcacgattaccataaacggtgatacccaaagtgccaaatagaatgaaatactgcacaacagaattagtatacgcgttgataccaattccagttggtccaagcacacgtgaaacatagggaattgtaatgatcggtaatagcaagacaaaaacctgataccccatattccataaaaagttctttactactgtcatataactctccgatcattggcctgttacctaagagtttgctttaatagaaacatgagaatcaaatttccgtcttaattcgttgcaaagaactttccttttacaaattgtagagcagcagtaataacttgatccatattataatatcgataaagtcctaaacggccaccaaacgcgacctgtggatattttttagtggcaagatctctgtattctgtaaataaatggttgttctttgtgtcatttacaggatagtagggctcatcacccttagaccattcagccggaaattcacgcgttatgaccgtcttaccttgatttccttttccaaattcaaaatgtttatgttcaatgattcgagtaaaaggtgtatcggaatcagtgtaattaactacagcatttccttgataattatcaacgtctagtacttcagtttcaaaacgaagacttcgatattccagcgcgcctaactgataatcaaagaattgatcgatcatacccgtgtatactacctgatcataacgagttaaatactcttccttatgggtaagaaaatccgtgtttaggtgaaccttaatgtttgcatgatccaacattttttcaacaatctgagtgtacccaccttcgggaattccttggtaaaggtcattaaaataattattgtcatacgtaaaccgaacaggaagtcggcggataataaatgaaggtagttctttaggttccctaccccactgtttagccgtgtagtctctaattagcttttcataaatatccttaccaacaagagatattgcttgttcttcaagattctgtggaacctttcccgccatggaagcccgttgtttatctatctctgctttggcttgagcgggagtgataactccccacatcttattaaaggtattcatattaaaaggtaaattatatatttcacctttgtagttggcaataacttcgtttgtatatctattaaatgatgaaaactggttaatatactcccagatttttttattactcgtgtgaaaaatatgtgctccgtatcgatgaacctgaataccttcaacttcttcagtaaaaatatttccggctaaatgactacgtttttcaatgacatcgacttgatccccttttagtgcacgctcatgagctactgtcgctccaaataagccagccccaacaactaataatttcattttaatacccccatatcaaattatgctccagattaacaaaatgtattactaattagctttggcctgtaggtgaccttgttcagcagacaaaacctttttgtctttggtgacaccttctgtcaagcttcctaagcacataaaaggaagtgccatatcaagggtgactaactttgtttcaactaacccaaaaagagctattgcagtgagccaaaacaaaagataggaatcgccaaaaatctttgcgcgaatgccacagtaagtcgaataaagaacttctagaactgcaccaaaccagccaaatatcataaccgaatacatatactgattatcaacgtatagatatctaacattaatagaccatgaataaaatgcgttagccaactctgcaatatcgccgccgaagaaacttttttgcgcgtaataatcataaacaagcttaagcagttctggacgcccagacatccattcatttaaagtttgaaagacctttgaactagatggaagaaatatggaaattgttaatgaacccagaaaacagattaacgggacaagtatgcaaaaactatataacagttttcgaaaacttatgcttttaaaagtattaaaaaccgtaaccaataccacaaaactcatcactgaaattagcgaaccacgcgagcgagtaaggacaaaaataagaattccgctcagaatcagcaaaacaataggcttaacgcttttccttgcgtacaaataaaacatttcaagagagatcatcattaagtacatccctaaagcattagggtgatgaaatccaaaagagaatctactgtatactccgagttgaataatcggactaaccgggagtaattgtagattattcacaacgaagagtgaaattgtaacaataatcctagcaaaaagatctatcctcaccagacttctaaaggaaactgtttgagaactccaaaccagaaatataaacgcaacaactgcaacttgttgattaacaaacagataaccataaacgataaccagaaagagaggcccagttataagccaatttaagagagaacgtcttttaagaaaacctaacactaggagtaatgacgcaaggaaatacgctgttttgttgccaaaagaaacaaaactcggataagcagatggttgatcaactggactgatcatcgactcggctgtgaagccaaagatgatgacgagccaaaaataaataaacaaatacgttttaaccaagaacggttgaaacgaatcttctaaattgtttgtttccatgtgtatcccctaagacaagtatgttattgtctaaacttgatatgatgggttacttctttccagtattcgtaccatacccataaccgtagccgtagccataccctcgatcgccgtgtttagctttaactcgttcaactgagccaagaattttagcattagcaagctttaaaacttcaaccgttcgtcgaagatcaccttttagagtcttgcccatattagccacaacaactacaccgtcagtttttggaaccaagacttgtacatcagatacggctaaaacaggtggggtatcaagaacgataatgtcatagttttccctggcccaattcagtaaatttgccattcttttagaatttaacaattcagagggatttggcggaataggtcctgacgtaatgacactcaaattatcaacaaatgtttcttctacaacagctccagcttcatcttttccaattagaattgttgttaccccgtctatattcaatgtcctaaacgtggcgtgaatagtcggtctcctgagatccgcatcaatcagcaaaacttttttcccagcttgggcccaagtaaccgcgacattagccgagaccgttgatttaccttcagacatggccgaagacgtaaacatgactacttggcaacgatctaaagcagccccagcaaattcaatattagtgcgcaccgttcgaaactgttcagacactacatgtttgggctcagcaaaagcgactagcataacgccattcttttgggtttcttgatcctcctgatgacgatgaaaaagtttagaaaatgataactgcatcatttattccccctcaaattcgacgacgactacgttgtggaaaatctattccatcaagatcgtcttgcacatcatttcctgaatccgttgctcgactttgttgtattgcctgatccatatctttcatgcgcacaacataattaacaattcctaggttaaccagccctaagtcatcagtaataaaatcaatatctttaatggtttggtcagtcaattcacgtacaagcccccagcttaacgcgattaagatgcctaaagccagcccaacaatactcaacaattttaatttaggagataccggaattgtattagccgttgctctagaaacaacagagacatttgagatactcatgattttagcaatttttttctcaaacaccttagcgatttcgtttgcaatatctcttgcgcgaactggactggtatctttaacatttacagtaaaaacctgcgaattctgttgtgtcgagaccgaaaccatcttcgtcaaatcctcttccgaaatattggaatatttggcgggtttgagtttatattttgcaggttgtgcttcctctgtgacgtacctttcgcgtgttcctgtaacggcattgtatcgtgttccataaacagcaggttttgctttcttgaccatcactcgctgcggactggtaagatcttccgccaccgcttgcaaaacaacgggacgtgtgatgatatccttatatgtattaataatctgaatatcagcttgttgtgcattcaactgcatgttcggatcgttgtcttgctttcgattaaccaacaatgatgtatctgattcatacttaggtgcaataaaagccttcgcaccaaaataagcagctgccattcctatgattccaaaaacaatcatagctaagaagctgcgtttgaacacattccacaactgtgaaaggtcgatctgtttgttcatgaactcttccccacctaattcaaaaattagtaacaataaattaaaaaacgagctgcaagctacacagccgcataaaaatagagacttttaaaatcccactccaaagcataataccctagcataagggtttaagtctacccatcttttaccggaatttcctttttactgtttatcgttaatcttttacgttagtctaatctccggtttagtgcttattgttaaccaaaatggactggtttattacagtctctttacaattttcaaaaatgcgaccacaatgtcccgaatttgtaaccagtatacaaacagttttagtttaaaataaacacaagtaacattggagggttaaaacttgaagaaaaaaagcggcttacgcttgcgtgacatcatactatgcatcgccctgggcctcgtcattgccggtgttggaggttatttctacttccgccatttccagtccgagcaggcgatcgcagttaatcagcaaacgcgtcagaagattaagaaggattcgaaggctaaggttaagaaagaaaaggttttgaatcagtatcgcctgtatggcctgaccgacagcgaaatcagtgccgccaagacgttaccggtgactgccattggtgattcggtgatgttgggaagttcggcttatttgaaggtgcttttcccgcagatgtcgattgacgctgaggttggccggcaagtgcaggcggctcctgctattattgatcagttgaagtcaagcggtaaattgaaggatactgtcgtcatcagtctgggaacgaatggaccgatgacggaagcagacattaatggcattttggagcagctggggagtaatcgtcaggttttctgggtgacagcttatgctcctgggaaggcttggattgatccggttaacaagttgattcacgccgctgctaagacgcatgcgaatctgcatgtggtggattggtattatctggctggcggtaacgatgattggtttgccgatgatggtgtgcaccctaatgacgcaggacgcgtgcattattacacgctgattgctaaggatgtcatgaagacagtgaataagaagtagccgtttatgcgcgttagtaatgctcgaaattaacaaatatatcaaaagtttcgcatcttctataccacaaaaaaacaccgattcactggccattttgaaagggcactgaatcggtgtttatttatgcaagttagccaagtttcgatcgcaatcacatttcttgatgctggtcaaatgttttcttgatcagctgaggtgcaatgacgccactgcgagtcacatcccaaggtgagccttttcgatgggttaagtggactagcccagcagccgtatagccgcggaaatcattatcaactttccgcaaaaggtcggcaatcttcctatcagattgaaccagattgaaatcttcgaaagccgatttttctagtgtttgcggaacaattccgcgtctaccattgtatttcttgtgaacatcttcaacgaccggtccgtatggcatggcgataattttcgatgtgaataactcaccgcctgtcttagcaatccatctgccgaatgcaaagtaaagcaacttaaccactttcatttgagttagttcttcagcattcggatctgtttttaagctgaagtagtttctaacacggaaccaattcgttaattgtaatgcagtaaattccgtgttgtgttttagtgaggtatccccagctttacgatcgcttagataggacgtcatttttttaacgatcttcttagataaattctgttgatttggagaaatgaatgatgcgagaaaatcgtcgtcattaatgagtgcctttaatatccgattattggattcagatggaaaagcaccggtttcatataaagcgatggttgtcggactccatcccattagatctgccaattctcgttgagacaaattcatacgcgcccggtatttttttatttcttcgggagaaacaatatccatctcttgtcgatactttgcattggccaatgctaccgcagcatcatcaaggcgttgatcaggaatcaactcgccagttctccgatcaaatttagctggtgcggttaccttgtattcttttccgcgaattagaaatgtattcgtgtggtctttgatgatatacggttgattcatactcgtcgcccctattcattataactttcgtggaaagaaataaacttaacccaatttgtatcctggttaattttaaatttcagataatagaaaacgccatattccgttttaaaaacccaaacgtactcatgactcccattacgatccagctcatgtttcttataatcgttgagggacagttgttgaacaattactttggctaagtccgcttcgactgcctgtgcgcgaggatttctccggttaacaaggctgaacctattttcgctgacaagatattttagcttagcgagtgtttcttccagtagattcataaccataccgtcctcgtatttgtacattgagcataacatctaagtttaataattgctacaattttgtagcatcaatggctctattaaaatcgcagtataaatatctggatgcgtacaactcaagaccttattagcagccacaacgcctataaacgaactcaagtcaagttggtgtaactattccactcgcctttttctgccaacacgttgccacaaaatgccagcaaccaagcgtattaaaaaagcgcccccaaaccatcgaggagacgctcacagatccgaaagtctaaaaactagaccttcgcaacttaacttaaaaatcacttatccaaatccacaaaccgcgtcagcaccatcatcacagcgccgccgactgccatcgaaagcgcttcgcctagcgcaatggtgccgtatgtcggccaaaatggtaccttgctgagcacgaccagctcaccggcgacggtaaacattgagagggcaaataagacgcccatgatggcaaatttggcccatttttggtggacgaacttagcgagccagcgactgagcaggatgaaggccaaggtgccgattgtgccgatgggaacgtcgagaatggcggttggtgatgctaagttggccaaaaaaacacccaacgtaaccgcccagacgtaccgacgattgaaaagcgccgtgtagttgagcatctcggagaaccgaacttgaacgatcccaaagcttaatggactaagcatgagggtcatcaccacatagatggcggcgacaatggcggttttggcgagactgacgattgaacgatgggtcatagatgttgtttgcatattgtttctcctttgtggctttgccagtaataacgacgatcaaaggaaataagtatcgtcgtggaagcgcgcggggcggttccgattcagttaatagttcttacaatgtttccagtttacttttccaaccaaccgccgtcaataggaatcacggtgccgtggatgtaatcggccgcgtcactggctaggaaaagtgtgagttgggcgacttcttccggcttggcccaacgtttggctggggtttcttttgcgacccaggtggccattttcccatcaccggcgaaatctgccgcgttcatgggcgtgttgatggcgccgggtgcaagagcgttggcgcggataccttgggcagcgtagtctagatccagttgcttggttaggccgatgaccgcgtgcttggcggcagtatatgccacgccaccgccaccgccaacgataccggcaatggaactcatgttgacgaaaacgccgtgaccacgcgccagcattccaggcagcagtgccttaatcatcaggaattggctggtgaggtcgacattgagaatatgctgccacgtggccaaatcggtttcggcaacggttttatagccatccaaaatacctgctgtgttgcatacaatgtccggcgtataatcagcggcaagcttctttcctgtctctggatcgctcacatcggcctgaattgcgacggtcacgccagtcattggttgcaagtcgacaccaatcacctgggcgccggccgctttaaaagccgccgcctgcgcagccccgatccctgatgccgccccggttacgaccacagtctggccgctaaaatcaaaccggttcatgcgtccacgagctgccaatcttcggccagaatgtcacagtcggtcggggaccacaagctgaaggcctcatcagcggttttgatcagaaaataaggattcagggtgtcgccttcgaacttaccttccggaaccagttgaacatacaactcggtaccttcccagccagtacgaacggccttttttccttcttttaatgctggcaaaacggcttcaaatgtcattgtcacttttcctcctttataagatgacccagcctgttcacagtgttactcgccaaggcccgtgtcatcgttgcggttaattcagtgcacttagtatacgcgatttttctgcctgcgaacagtcttaaccacatgcagcttttcaaaacgtgcgcagaattccgctaattggtagcaaacataacttttccgaaaacattaaaacggctctaaagacaaagtgtctctagaaccgtttttgcacttattggcaaccgccgcaagttcgcctacgacacgctcagaggttaatcacctgcatgagtacctcggagacgtgtgcgcgttcgttttccggcaaccgcgttaaatacttaaccaacgccaacgtattgatatcgctcatttccggggcgataaagaaatcacccacctgcatgtcgagtgcccgcgcaatgtcagtcagcttcttgacgctaatattgttgacatcaccacgttccatgcgggatatgagactgacagaaaccccagagcgttcggccagtttttcaatggttaagttcatactgcggcgttgttggtgcactaatttgccgatattatctaacatcatgttccccacctctaatgtgcggcgttatgctttaacattaaatgaaacgtccgaccatcaaaagattttataatattatttaataatccaaagacggcctattgtcacacaacgccggtgcaagaccccacattaactaaccatttcacttctcagtatcattgtaagcgctcgccttgcgaaagtgccaaatattggcttgataatttttttaataaaaaacaatgccgggtgggtggcattgttacttggtttgatattcacttggtacaaatgcccacagcgtgccgcgggtaaattgttccccgtcacctgtatccaattcactgatgctgttgttaggcggcatggtcatctcatcacgcgcatcgtccaactcggcgcctagataagtgctcattagcagcatgcccaacaacccatgggccaccacgagcaccttaccatccggatgttgctgataaatgccggcaatagcgcggcgcccacgatttaaagcctcagcgaaggattcagcgccaatccgcttataatcaaactcagcgagatggtgatagtaattatcaatttgcggatcgtcttgcacggaagcaagtagctgcccgtcccaatcgcctaaatcgacttcccgcagatcccgtaccgtcacgatcgccggctgcgaaaccttgctttgcgccacgatcaattcagcggtggtttgcgcccgcggcatcggactggcgtaaataccggcaaaaccggtcgtagcaaaataccgtccaactgcctccgcgcctgcccggccagccggagtcagcggcgtatccgtccgcccgccattgaaccgccgcgccaaattggtctccgtctgcccatggcgcacaaaataaaacttggtcatccttccacacactcctttaaaaccagtgtagcagaagattcgctgaaaacgttacctcaccataaaaacgcggcctagtttaaacaagcttaaagatcagaattagctattcgaaccgttttcttgcgccaatactgcggatatgacaaaaagccgaggacacattttcagtgttttcggctttttgttgtaagaatcatttttaaagattcgccctagcagaatgttatcatgtttgaccgcgttattctgctgccgtgcctgctggggccttatgatcctcttgtgcttcagctttatacgctgccacttcatcgtcagctgcaaagataaagtggtcaggatagacttcgaccattttacgttgcttattatcgccttcgaccttgcttgcatcataaggtatcggtacacgctggcgttcgatgtctggatcgggaactgggattgcagacaagagactcttggtgtatggatggaggggatgtgtgtatacttcttccgcactggccaattcgacaagccgcccgtaatgcataacggcaatccgatcagaaatatacttgaccatagataagtcatgggcgatgaacagatacgtcagaccttgccgatcctgaatgtcttttagcaagttgacgacctgtgcctgaatcgaaacatccagcgcactgatcggttcatcggcaataatgaacttcggctgaactgccagtgcccgggcaatcccgattctttgacgctggccaccggagaattcatgcgggtaacgcgtggcatgatccgcatttaaaccaacctcatccaataaagcttcgacttgatgatcacggtcggcgcgatctttagccaaatgatgaatatcaataccttctgcaataatgtctttgactttcatccgtggatttaatgaggcatacggatcctgaaaaatcatctgcgtattacgccggaaatccaacatttgtttggagccatttttcaatttggcaatgtcttgaccgttatagagaatttcgccactggttggatcatacaagcgaatgatagcccggccggtggtggttttcccggaaccggattcaccaaccagacctagcgtttcgccctcatagatatcaaacgaaatatcttgaatggcctttacttcgtctttctttccggcattaaaggtttgaaccagatgtttgaccgaaaccaacacttttttcttttgactgtccgccacgttagttcaccgccttttcgtctggatgtttacttgcccataatgcatgccgccgcgcgatttctggcggtaactcgactttgggtgcgcctggtgctaacaaccaagtagccgcagcgtgggttggtgaaatcttgaagaatggtggttcttcttcaagatcaattgccatggcatacggattgcgcggggcaaatgcgtcaccctttggcggatccagcaaatccggcggtgtccccggaatggcatacagacgatccgttttggtctctaaggtcggcattgcctccagcagtccccaagtatatggatgctgcgcgttgtaaaagatttcgtcaacggtgccgtattcgacaatcttacccgcgtacatgactgccacccgatcggcaatcccggcaacgacgccgagatcgtgggtgataaagataatggaagtatcaatcttagactggatttccttcagcatgtgaataatttgcgcttgaatagtcacatccagcgccgtggtcggttcatctgcgagcagaatctgcggatggttaataatcgcaatcgcaatgacaatccgttgacgttggccgccagagaactgatgcggataatctttcaatcgtgaaccggcgcctttgatacccactagttcaagcacccgttcagcttccttcaatgcatcggccttgctcattttgttatgcagcaacagcggttcagcaacttgcttaccaatcgtcatcgttggatccagtgacgtcatcggatcctgaaaaatcatggcaacatcattaccgcgcatggcattcaattgcttttccgactttttaagaatgtcaccgccatcaaacaaaacttcaccattggtaatcttggcgttgggtgccaataagcccatgactgtgcgcacggttaccgatttaccagagccagattcgccaacaatcgccaacgtctcgcctttgttcaagtcaaagctgacattgcgaatcgcgtggaccggtccggcataggtggcaaagtcgatttgtaaatcttttacttcgagaatcttactcattttgccacctcctaatgttcactgcgcggatcaaaggcatcgcgcaaaccatcagccagcaagttaaaggccagcatcagaataacgatgacaatcgctgggtataacaactgatacggcagcacttgcaggttcttttgcccatctgacaacagcgtccctaaactagcagtcggtgctggcaaaccaatcccgatataactcaggaaggcttcaaagaagatcgctgttggaatcgtgaacatggtttgaataatgatgatcgagcttaggttcggaatcaaatgtttaaaagcgatcttaatactcgactcgcctaacgttctggcggccagcacaaactcctgatcttttaactgcagggtctgcgcacgaatgagtcgtgccatcgtgacccagccagtcaaagcaatcgctaagataatggaagtcatccctggtttgaataccagcagcatcagaataacaacaaccaagtttggcacactagagatgatttcaatgacacgttgcattaacgtatcggtcaaaccaccgcgccaaccggagatgatgccgtagaaaacgccaatggttaaatcaaagaatgttgcaacaatcccgatgaaaagggaaacgcgcgtgccgaccataatccgagacagcaaatcacgcccaaggtagtccgtcccaagcaggaaatagacgtttttacccataccggcatatttgttttggccattcatatagccgtttagtcccggcaaatcaatgcctggccactttggcggtaaattagaataattaagactctgtttattcggattggctggtgatagccaaattgacacgatagagatcacaccaatgatgatcagtacccaaagtgaaatgaccgcggccttatttttctttaagcggcgaatcgcatcttgcgtgaatgtcaacgcaggcgtggcaatacgctcttgttcagccgcattcactttgacacgcttgaatgcctctggacttaattttgttgttgccattagtttgcctccccgctcagtcgaattcgtggatcaatgaagccgtatagaatatcgacaacaaggatcacaaccgttaacatcgcactgtaaagaatcgttaagcccatgatgaccggataatcgttcgttgtgatggacttgacaaattgttccccgattccgggaatggcaaaaatgttttcgacaaccagtgatccaaccatcaagtcaactgccattggcccaataatcgttacaatcggaatcatggaattacgcaaagcatgttttgccacaacctgccagcgcgattcacctttagaccgagctagctcgatataatccgagctcagcacgtccaccatctcggttcgcataaaccgcgctgtctgtgccaacggggcgatcgccaaggcaatggtcggcaaaatactatatgaaaacccaccccataacgctaccgggaatgtccctgtcttgtaagcaaacaactgcaacagcgcagcaaacacgaagttaggaattgagcgtcccagaatagcgaaaattgtagcttcggcatcaacggcagtgttctttcgaattgccgcaatggcaccaagcacaatcccgataagtgttccaagcaccattgcctgcgcaccgatctgtagcgaaggaccgagccgggaaacaatcagattggaaaccgtttggcccggaaattgataagacatcccgaagtcaccgtgcgtgataccaaccatatacgtgagatattggatccaaaccggcttatccagtccatactgtctcttcagaatttccagctgatcagccggaatcttggggttattaaatggcgtccctggcaatgccttcattaaaaagaaggtgattgacgcaacaagaaacagtgtcaggagcaggaagccgatccgttttaaaatatatttgaccatgattcactcctgttttttgggcattggccctaataagcaaacggcgttgtccgccgcaaaacacgtgacaacgccgcttgtgagaactacttattggaaacaagttccgatttaggaaaccctgtaagattcctaaacgcgttgatctgtctaacagttgctaagacaggtcacgcttttattacttaaccttggcatttacaaaatcgtaagagttagtcgggttatatttcaaaccggtaatggtcttacgttgcaaggttgtttgaacccgttgatacaaaggtacaacgccttgttctttagtgagcagttcttgtgctttcaacaaggtgttccaacgagcggtggcattggttgcatcggtcgtcttggactgtttgatcaaagcatcgtattcgctgtttgcccatttaccatcgttataactattatcggacgtaaacagatcaaggaaggtaatggcatccgggaagtcagcactccaagcggagataaccatgtcaaactgaccattttgagaacgggaaagacgggtcttgaatggcactgttgcaattgttaccttcaagcctggcagattctgttgtaaggtgctttgaatgtattcagccgagcgcttggcattcgtggtatcatcggtcaacagttccaaggttgggttcgtctgaccggtctctttcaagccttctgtccagagttgtttagccttagcaggatcatacttaactgtagaagattctgctttagtcgctgcctttgagaagtcctgtccattcttagcaaataaaccttgaggcgtcacattgttcgcagcaattgatgaatcattcaaaactttcttgatgtattcttgacgattgattgccatcgagactgcctgacgaatcttggtattcttgaagataggatctttcttctcattcaactcaagataaaatgttgcactttgcttaagcggtgtgtatccagacattgtcttagcttgtgctgcctgttcacctgacaactgagcaatatccaacttattcgattgatacaggttcaaagcagtttgcggatccttaaccacttgcccattgatcgtatcgatgtggacattcttagcattccagtaggttttgttcttcttttccttccatgaattaccagtcccattccaatcttttaattcataagggccattcgagagaaggtacttagaagtcgtgccatacttcttaccaaccttttcaacaaacttctcattctgcgggaagaatgccggattgactaacatggtcttaaagtaaggaatggcgtgatccaaggtcactttcagcgtggtcttgttaaccgctgtaacgcctaaggtactagctgccttcttaccggctgtgatatcgtccgcgttcttcacgccggaatacagataagcatactgagacttggtcttaggatcaaccgttcgccgccaagcaaaaacaaaatcctgtgcagtaacggcatcgccattgctccatttagcgttccgtagcttaaaggtataagtcttgccgccgtccgtcacttttggctcgctttttgcgatcgctggcttcaagtcactgccggaataccgatacaaaccatccatggtatcaatcaatgcttgccccgcaatcgcgtccgtatttgttgacggatccattgtggagataacatcactttccatccgagtgattgatgtacctttgctgctggaagcattagaaccacaggctgccagcaccccagcgagcgcaattgctgtgcccgcaaccattgtttttctaaatttcatcctgttccctcctaaaatgattgaacttaccttacattagaatctcattaatgtaaataagcgaatcctcaattttgaataaaaaaacttgtatgtcataaaacatcacaggaaaagaagcggaagttattgggacaacatcttgtgcatcaactatgcatatttttaaatctcccgttaaaacggggatttacaaggtactaaactgtttactttagatgatcctttggggaaaccgctaaacttttacagaaatccgcgaatattaaataacatcaatttatgtccctaaaattggcttgtttttccctgaccgccattctttcagacataattttcacttctgtcaaaccagaaatgaaaaacattgtcgccgctcagttaatgctaatcgttttcaaagtacatgcttattttttgtcagtaccgcgttcgcttgtcgttttcgcagactgcggataatgacaatgattaagcccaccaccgatactaaagtggctaaccaaaaaactgttgccagtgcgtgtagaaaaggggcgcccgattgagctgagatgcgggtcacaccgggcaattgggcaaatagtaacgtggcgccgaagctaataccgatcgttaagccaacggtgcgtgccagtgaattcaacgaaccggctactcctgagagtttgtcatcgacggctcccatcgttagcgcattgttcggcgaaaggaacagtgccatccctgctccgttagccacaatcgaccagataatcggtgccatagtgattctgactggataattggcatacccgatttgcgagatgattaacactaataagcctaaaatcgttaaatagtaccgattccaatgatcggccaaccagccggcaaatggcgtgatcaccaacatcgtgacactttgtagcatcatcagtaacccgcttgaaaatgctgagattcccccatagctttgaagataaaatggcaaaagaatgtttgatactgaattaaccagcatcacgataagcaagacgctaacagaaatcagatagtcggcgttatgcataatcaccggtgcaatccaaggagaccgggcctgctgatcttgcacaaacgccaggaccgtcaagaaaatgccgcctgccaacacccctgtaccgagccaaaattgcattggctgctgtaaccagtatccactggcaaacatcaggatcatgcccccggtaaacagattctgaccggtccagtttgcctgctgccacacgcgcctaatttcaccgggttcggggcgacgtaacggcaacacgcgcatacctgcaaggacaatgaagatcccgactggcacattaaataagtaaatccaccgccaactcgcccaggtaatcaggatgccgccaaatgccggaccggaaatcgagccgattgatataaacatcgaaatgaccgccaatgcctcagcacgggtcgcatcgggaaaatattcactgataatccccatcgaattagccataatcatcgccgagccaactgcctggaccacgcgcccggccatgatggtgaaataagttggcgcaatgccggtcagtagcgagcccacgatgaaaatgacctcgcccagcagaaacacgagatttttggagactaaatcaccgatatggccaaacatcacgagcaagactgccgttgtaatgaggccaattgaaacaatccatgttgctgcactgcttgagatcatcaagtcttcggagatcttcggcattgccaggttcgtgctagaaccagacaaagcggttaataatgacatcagccctaaaatgatcaagatttttatgcgttgcacccgcgccatcgccaatgctcccacaccctttcgcatgtattctatgctcgttagccaccagctacaattattccgccctgtagcaaataaggtgtgcgtcattttaattctggcctttgatacgcatagactctggcaatgacgcgctcaccaaaaaaggcgacgcatcattgcgtcacctttcgataatctaattaatcactatttttgcgcgcgtcccttataagcacccgtatccgtggtcaccaaaatgttttcgcctgctttgacaaaatcaggcacagtcaccaccagcccggtttcaagtgtggctggtttgccgccgcccgcaaccgttccgcctttgacagacggctgggtgtcggtcaccttgagttcaacggttccgggaagttcaagcccgatcacttcatcaccgtaaaactcaatttcgaccggaatatttggcagcatgaacttcaactcgtgctcaatacttgaagtcggtaattcatactgttcatagctatcactgtccatgaaataagcagtatcatcttgcgtatacagatacgttgcttttttccgatccatgatggcgatttcgattttttcactcggccgcatggtcgtcatgacattggcgccggaacgaacgtcatacagtttcatctgcatcacggtgtttcctttgcctggcttatgatgatttgattccaaaaccttgatcagtttgccatccttaacaaaaaccattccggccttcaaatcgattgcttccgtcatgtcgttatcccctttatttccattgtgctgttattgcacgtctcagaatttagtataccataataccttgtgcgggagccggcactaactagggatgaagtgtaagtgtcagccctttccttggttctactctaattaagtgatttccgatactccgagctggctccgcggtggctggggctggcgaccgcgcagctagagtggtgggcgcgacttcgaacccgcaaagaccgcggtttcgaagctcggccttggtctaaagcggagaagcccactccgcttaagaccaatttcaccactgagcccgccaccgctccgccagctcttgctttctatccctgcactcaaacaacgagactcaacgtatccttcgttgaagagtacgttccaattaatccgataagtataatctgtccaaccaaaaaagccgaccctagcgcagatacgctcgctaggcccgacttttcccgcaactcatcagctaaaacagtcgctacatatcctcaacgaccaaatacgtcatgtctagcggtccatggacaccgacgaccaaggtcatttcgatgtcgccggagttggaaggtccggtgatgaagttgatgttgctggtttctagctgtccggccttcattgcggcatcgtagcgatccatggcttggcgtgaacgtggcaggatgttgcttttcttgacgattgctaaataatgcgtcgacagaaaatggaagcctcggccttgtccgggcgtggtcgcaacggtgatggtcccggattctgctaatagataatccgcaaagccaatggccacatccgcagccgcagcttgcttcaagttgaagtcacggccttttccgggggtccagtacattggcttgggagtaacggtttgcgtccactcgtctaggccatagtcgtggtattggtccgtggttggcaaaatgagtgtcttgggcgcatcgtgttcgatgtaagcgttgagcgcggttgccaactctgctttggtggtggtttcaaacgtgacatgcaccgcttcactgttttgcttggcgatggcttccaactcatcttgggaatggccggacagagttgtttccggcaagtcgtttaaaggcacaaacggatgatccttgagctggtgccgcgggcggccggctttttcggcaatagcatttaaaaagtcctcgcgattactgtgatcaatcatgcttttccgcctccaatgctgctttgtgttgtttgaaccaatggcggaaattctcgtttttcttcggtggtcgcggcaagtcacgcacatcggtccaaccgcgggccagcttgggcatcatgccggtttgtttaattcggccgctgttgtattcattttcaacactgccttgatctttggttgccaaaacacccatcattgcgtggtccatatcaagcgccatgttgaacagaaccggcgcactggtgccgacgccgaccattttcatgattttatcgctaaaactgtgatcggttttcagcttgtccatcattacttcccggtgcttgattaacagatggtgcagcgggatgcggacagggcaggtttcggtgcaggccgcgcatagactggaagcaaatggtaggtcgccgaatttttcatagccatccagcactggtgacagcaccgcaccaatcggtcccggataaatcgaaccgtaaccgtgaccgccaatgtgccggtataccgggcaaacattcaggcaggccccgcaacgaatacactgcaagaccggctcaaatggcgttcctaaagcattgctgcggccgttgtcgacaatgaccacgtggaagtcttccgggccgtctgcttcaccggcaacttgtttaccggagaaggaacagtaactggtcagcttctgtcccaccgccgagcgcgaaagcatgttgtctagcgtctcggcttccttgagactcggcacaatccgttccatccccatcacaactacctgcgtcttaggaatggccatggtcagatccgcattgccttcattggtgaccaagttaatcaagccggaatcggcaatggcaaaattacacccggtaatcccgaagtcggcttgcaagaaatagcggcgcaaatattcccgcgcaaaccgcgccaaatgttccggatcgttatcccctttgtagccgagcttatcaaaaatcgtcttaacttgatcccgattcttggccaacgccgggaacacaatatgcgtcggttcagcccagtcgtcttcttgcaaaataaattccgccaaatcggtttccatcagctgggtgcccggaagtttcagtagctccttgtccagattgatttctgttgtcaccatggatttggatttaacgattttatgcgcctgcttttgcttggcaaggttggtaatgtaggctgcggcttctttgtctgtcttggcaaaataaacatgaccgccgcgtttttcgatattatcgctgaattcttctaaataatccggtaagtatttaatgacatgttgacgaatctgctcgcctaagtcccgccattgcggccaattacccagctctttacgcgaagcctcgcgcttgtcccactgcgcatcctgcgacttggcaacactggcttgcatgaacttatcctgttccgattctttaacccgctccaagaacggcttgtcactggttgaaatgctcatgggcgcacctcctgttcaaccccgagcggttcatgaaacttgatccgctccggattcacattgtggttcaatacttcggcaatgtgcataatcttaatcttttcgttacggcgggaaaaacggccggcgatgttcatcaggcacgcgggatcggctgaaatcagcacatgtgcgccggtactgagcacatcgttgactttttcatcaaccatttgcttggaaatttccggctctttggctgaaaacatcccgccaaaaccgcaacaattttcaatatgtggcaaaggttccatctgtaagtccttaacgtgatccagcaagacaaacggtgccgtgcgttcgcctagcaaccgggtcatgtggcaggagcgatggtaagtggctttggcatctaactcagcgccggcatcaatgacattcaagacgcgatacagaaactgggaaaattcatacgtcttgtctgccacttctttagccttttgggcgtattccagatcgtctttcaatagcacccgatattcgcgcaacatgttcacgcaagaaccggctggcccgacaatataatcggcatcaaccgaaagcagcgcgtcaatttcgttgcgaaacaccttttgactttccttcacatacccggagttgtaagtcggttggccgcaacaaatctgtttgatcggcatgaaggtttcacacccaaaccgttccaacacctcgaccatcgccgctccgacattggggaagaaaagatccacgatgcaggtggagaaaataactactttcataatgcacctcccatattacaatcattccaatttaactatacacctgtgacaacggattagacaccgaaaacggtttcaaaatgttaaatgttatttttattggcgcctctttttccgccatgctaaccgtgccattttcttcgcacttttgttggcagatgggtaaccctgttttaggagcataaccggtctggatagctacaatgtataccatttatagaaccataatcaatatcaatttatttatattggccactacccgacacgccgagagctcgttcttttcacaagcgtaaaacagtgtcttttcattgatataccgctgttcctcacggtttcacagccttgatttttttcttaaaaggactatcgttgaaggtgagttagggttacctaaataactcaaatcaaacaggaggcgggtttatgcggaagcaatatagggcaacattgcgggcgcttaactcagattgcattggtcggcaggcacatggctttgcaaattttgaagttaccgatgatgatgctctgcagattcgcattgaaatgttcaatacgccagcggacatgaatcacatggcagtcttggaaagctccggttccgatgcgccggtcacgccagccacaagtgctcaggatcagaatcatgatggggtcgtcgatgaagaagaagccgaacaagtttccggtaaagtctttgtccctctcgataatgcaccggataagttgaagttggtgggtggcaaataccctgaagccgacgacaacgggttctatatttaccagcagcgggttgtcgtatcccaacttcgccaacaactggcgaaacattatggtcatgatgttttcaccctagacaataccgtggtttacgtcaacggggttcaaaatgacgtcttgttaccaaaaaccgtggcgagtgatttagatgaaaaaaagccttatctcactttgccaattgcagtgggtaagttgtacaaggtcatgggctgatagttgcgacactgctaatctaataaaaagactggaacaaagcatctcatctttccagagatgctccgtcccagccttttggttatcttcgcaataaccgcgtgttttacatataaaattcattcattgtgcaactggcattgtgcaactggctatcacgcaatggcttaaagcgtttcatttgcaacggtcgtatttgcagccaagcgttgataaatcgcgaccacttcgccagccaagtcgcgaaaagtaatggcgttcatcagatgatcctgggcgtggactagtagtaatgaaacatctgcgtgcgctccgttggcttcggcggtcaataaatcggtttggacattgtgcgccgtgaccagagcctcatccgctgcttttaaatggctggttgcagcatcaaagtcactgttcttggctgcttgaatggcttcaaaggcttcacttttagcgttgccccctgccataatcaagcccataatcgtttgttcgttgacgttgctcatggggtcactcctatctgtcattattagtgggacacctgttttaacataaatgttcgccatggcttaagcagtggcaacaaggtcagatcttcatctgtcaggcggccgattttgttgcggcggccgtcattaggcaattcccgcaagacaatttgtagttcaccggcgtaccgcgtatacgtttcgttcacgacgactacatccccgcgctgcaagtgaccgctcgcatcatgcactggcaaaggctgcccggcataacgcacgcgtggttgggtatcgcgaatcagataatcagacgcatcaccgcgataaagatgggcttcgctaaaggcaattttggcttctaacgctgatggtgcctggtccgtgattacccgcaatgccggatacgggcaaaagaatgccaaggccgcggcttttaaatctgcttcgcttgcaagtgcattgccgatgagaacatcatcaatcacctcagttaggcgcaaatggtgaacctgactggcaatgctgcgatggcgatcgctttccaaagtcggtaaaccttcacttaccggccacggtccatgatccgcacttggcgccgtcacaaaagccgccgtccggacgccatgccgccgaaacttttgcgaataggccaaaaagcggtcatcgcctaagccggtatattgctgcggataaaaattatggcaacccagcaagttatccagtcgcggcccaaacgccatgattgcatcaatggcattcgtaccggcactcatattcagctcaattttcaagccatattgattatgagtcatcaaggcttcctcttgaccggtgaagccctcatcaagccgcaacccccatacgcctaattcatggaagaaactaaggtcttgataatcaatgcctagttccttgaacagcggcggcgcaatgtcgacaatcgtttgaaagcccaactgattcgccttggcaaccaccgccttgaaaatagcgagttgatcgcggccttgatgaccggatagttgcagtaatgaggtgaaaagacgccgataaccaaactgacgggccatggttaaataatcagttgcctgatcaaccgttatttgttcgggataaagactgattccgatttttcccatgtcaatctcctatattttttactgatggtgtggctgggtcactcaagccacgttcatccaagctgttttacaaccggttctttaaatcgcacacatttgccgcgccattttcttgaagcgccgtttacgcaaccaacctaaaaggaatccgctagtccggttgttcgctgcaccgcgagcggtacgggcgactagtgcttcttcataaaccagtcgactttttccggcagacaacggcgacaagtggtaccgcacggtgaagtcatcactcggggtcgccagttcatatgcgtagactgaatttggtgcaaactcggtaatcgtcagccgcgcttttcgcccattcggccaatttttctcgtagctaaagccctgcaaactcttggctagcggctcacgaccggtgtgctggcgaatatcggccatggcggattgttgcagttggttgaagaagacactggcttcaacgggtagattcatgacaattttcatattgacctccttttggacaagctgcgaactgaacgcatagttgcagcaacatgcttcagcaaacgttgcgctgcgatctactcttctcttgccagaccgagataccagcgtgtgcaaatggcagttgcgaccaccccgaatagacagctaatgattcgccaaggtgccggtaaaatggcactgaagacaatcacggtcatgctgaggttaagcaagatcaatggtgtcgtgctaggcttcaaatcgcatcaccttctaaattgcgatcaccattgcgatcatcggcaacggttttggcttttttcattggtggttcagggacagttaattcaggatcgagtttgttggccgctttgacaaacggtacgtaaatcaggaagccaatgaccatgttgacggcttgcagaatcggggcgcgccaatccattgtcgcaatgatcgagttcacaaatggcggcatggaccagacaatttggttcttaaccggtgacacccagccgagcatgtgggcgccgtacgcgatggataccatgacaaccggcgcgagaataaatggaatgaagtagattgggtcaaggacaatcggcagtccgaacatcaccggctcgttcacgttaaaacagcccggtgcgatcgacaatttggccacggtgcgttgatcgtcacgtttggagaacatcaggatcgcaatcaaaagtaataaggtactgccggcgccaccgatccacgcatacaagtcaaaggcgtttcgggtccagacaaacggcagtgcttcacctttcatgaacgcattcatattggcaatttgggcggtgagccagatggaatccagaaccggtcccaaaacgttggtgccgtgaagcccgaagaaccagaaaatttgtaccagcaacgtcatgagtaacacggcccagaagccttgcgacatattcaacaacggttcttgcacgatggtcgcgatgaattcgatgaccgtggtcttgtttaaactgaacagataattcacaacgccagccagatataaggcggcagttgctggaatgataccggtaaatgctttagcaatcgctggtggcactgcttctggcatccggatcgtcacgttctttttcattaaccagatgtaaagcgtcatcgccaaggcgcccatgatcatgacggtgaagaagccataggaaccgaagaacttaccaaagttgaaaaagccccacatgctcacgttcttgccatcgactaccccaccggcatcggtgattaacttggcagcacctttactcagcgtgccttttagcggcagcatgaagttttgcggcaggctcataataaacgtgcctaataccacaatgcccccggtcaccggctcaacttggtattgaactgccagctggtaaccaaacgtaaaggcaaatagcagacctaaaattgccagtgtgccggtccaaaccatggcgttgataccgatcagccactgcatggaatcgactatccccatccacttaaattgggtcggaatatcgcgaatcaaaacgttcaagacagtggaaaccgccccggccatcatcgccggcatgatcgcaataaacgcgtcacgcaacgccactaaccaacgaatggagcctatcttggctgcaaccggcacaacatgtcgattcaaccatcctataaatgcattcatatcactgtactcccttcagaattttaaataatgtcgcattaatacttaactacaattaaaattctacgggagtgcagatcggcgagtcaaagattatagtagttattatttataatttttataagcaaaaagtttgactttttcagcttgtttaagcgttttcacaagggcgcgtatcggtatcgtgtttgaacgaatgcatcttatactttgccgagtttaaagattgcttctctgcagggcgttgatacttacataaatctcgcttacgagcaaatataacctctattgcttataatagattaaagttagaaattttcagcgcaaccacacgccacaacgcgctccccaccgcagaagccggctcgcgctcacaggaggattaccatggcaaacatagaatacgacccgcaaaaacagcttttccacctgcataacgatacgtttagctatatcattcaggtgattcgcggctatttggtcaagcggtattgcggaccggcgcttgaacgtttttccggtactgccaagctggaagatttcagtcatgcgtttaacattcaaaatgatgcggcaccgttttcgctcacgaccttgccgcttgaatatagtacgctgatgggcggggattatcggacgcctggctatgccgttcgcaatgggcatggacaattgatcgggaatctgaagtttcatgattttcagattctggcgggaaataaaaacttcaatggtactttgccgaccgcgcgcaccccgcatgggcagacgctggtgatcacgatgcatgacgaaaccgatacgctggcggtgaatctcaagtacaccatcgttggcgatctgcctgtcctgcttaagcaagtggcttaccataatctaagtgacgacaccctcacgattacccatgcagccagcttgcaactggattttgatgatcacgcttacgatctcattactttgacgggcgcccatctcagcgaagccagcgtcacccggcaaccgctcacaccgggtaaaaagtcaatcgccagcaattatggtgccagtggtccacaaggggttccggcaacgattctggcggcaccggcaactgatgactttgcaggcgaggcgcttggtatggcgctgttgtggagtggtaattttagctacaccgcgcaagtcgatcagtttggcaacagtcggctggtgatgggcctgaatccggagctcttttcctggcagctgaagcctggtgaaccgtttgtgaccccggaagcagcggtggcgtacacgaccaatggcttgaatgatctcagtcatattttccaccgcttttttgccgatcacgtcatgccattgccgcggaaaaatctgatcgaatataacacttgggagtccacgtactttgatgtcagtgaagccaaggtgcgcgcggaaatccctaaggccgaggcgctcggagtcgaattgattgtgattgatgatggctggttcaaaaatcggccgaatgatgccggtcagctcggcgattgggtgcctgatccggtcaagtttccgcgcgggttgcggcccattgccgatgccttgcacgagcgcggactagcattcggtttatgggtcgaaccggaaatgataactgaaaatagtgagttatatgccaaacatccagactgggcgatgcaatatgttggccaaaagccgttacgttcgcgcaatcagttaattctggatcttagccagcgaattgttcaggatcatctgattaaggtgctaaccgatttggtccggaccaatcatattgattatttaaaatgggattacaaccgtcatttcagccagcccggcagtccggtactgccacctgatcaacaaggcgaagtcgcctatcgttacacccgcggcttgtatcgggttttgaaaacattgcgcgacacttttcccgatttgcttatcgaaaattgttcgtcaggcggtggccggttggatggcgggatgctggcctatacggatcaaacctggaccagcgatttcaccgatcccgtttaccggatgaaaattatgaacggcttctccttattcttcccgcttaaaaccttcgtctcgcatttcacgatgtcaccaaatttgcaggactcgcgggtgacgcctttgcaaacgcgggcgctgcttagtctggtgggcgttactgggattgagtgtccgccaagccagttgagtgacgctgaagccgcggcggttaaagccagctttgtcttttacaaagctaatcgcacagaattgcaaaatggcagtctttatcggctgcatcccagtcatccgaatcaggatcaggtatgctggctgatcaccaacgaagccaaaaccaaggcgctcgtcttaacgtcagctggcgtggtttccccgattccgcactaccaacatgtgctgttgcattatctcaacccggaagtatcctaccagattaatgacaaggccacggccaccggtgctgaactcaattatgccgggatcactttaccgctggcgcatggtgatttttccgctaccttaatgacgttgcgcgtggtgagtcacctgccacaaaccacggcactgcctggtggcgacatcggtgaattgcgattttagcgaagtcagcaaaagtttcttaagtagtttatcttatatagaaagtttggtttccacatgaagtttatcatcgcaccggctaagaaaatggtggtcgctcaggacgatttccccgttcaaagtcagccgcagtttcgcgatcaggcggcgtggctgttgcgtcacatgcagcagctcacccgcgcagaagcccaaacactgtggcataccagcgaaaaactcaccgacgcggcctacgcacagctgcaaaccagtgacgtgacggcgcaccaatcccctgcgattttcagctatgtcgggattcagtatcagtacatggcgcctgatctgttggatgacgccggcttagcctatattcagcaacatttacggattttgtctggtctatacggtattttgcgaccgtttgacggcattgttccatatcggttggaaatgcaaacccgtctggctgcggtaccgaatcatagcttatataatttttggggcgatcggctgtatcaggcactggcgaccatccccggcccgatcatcaacctcgcctctgatgaatatgccaaaactatccgtccttacctgcagccggctgatcagtttattaacgtcctctttgcccatgacatcaacggcaaactcaaaacgcgtgcgacttatgctaaaatggcacgcggggaaatggtgcggtttgccgccacgcatcgcattacaacagtggaggaactgacgcactttgactcgccgacttatcggtttgatgcgccactttcgaccacggatgagcttgtttttattgcaaaataggacaagttgacttccgagaatggcctacaaccaagtccagctttacttttgggcttggttgtaggtcacttttttagttgttaggacttttttaagtgacaaaatgactgtctgcgagttaatatataaacaatataaagaaaggtttgtttataaaatgacaaatagcatttccgtttataaaatatccgaattgcagcagggttactacctagaatccggctaccttcactgccactattgcgacactagtttcgccgaagatgaagtttacccacaagacggccgttacttcactgctgaagcgatgatcaaacgccacattcaacaggtccacaacggtgcattggccgccttactgcaacagccagctagtcaactcggtgtatctgccagtcagcaacaggttctgcgcctgtttgcccaaggattaagcgacacggtgattgcccagcgcttaaaagtctcggcttccaccattcgcaactatcgcttcaagtttcgggaaaaacagcagcaggcacagcattttctcgccgccatggccttgctcgccttgccggatgccctgatcatgccgcatgatggcgccaccatgattgatgaccggtacgcgattaccccacaagaacgggaaaagaccttaaaagccttcctcactcctgatggccgggtgacaaattggcccgccaaggaaaaacgtaaactgatcattttgtccgagattttcaaagacttcaacccgcagaaaaactattccgaaaccgcggtcaacgaaattctgcagcgacacgtatcggattacgtcaccgttcgccgcaatctgatcgaatacggcttcctcgatcgcaccgcagacggccgcacttactgggtaaacgctaacggactggcacgttaagcacgtagaaagttttaactggcattatcggatgcaaaaaagtcacgccaacaatgagcgtgactttttacatatatcaatgttcctcagacgatttacgaaccggcaacttggccaccgtctcaacaacttgattcaaaatatccagctgctcagcataacgcaccgaaaatggttggctggtggcatcaggcttttctgcctccagtgccgcgcgcggttggttaccttggcgttgctgatgatccaaccacgccagtatctgttcaaatgtgaagcggctgaagttatccaccgtcaattgtcccgatagcaggctgccgagtaagtcgtggcgggtgtccatgggataaatctgcgtccgcgccagcaacacccgaaagtcgccaaaaaagataaagcgtgcttgcgttcgcgtcaacgcggtataaaagctctgggcatttaacatatgatcggccccattaacaatggcgatcaccgtatccgcctgaccgccttgcgctttgtggaccgtgatcgcatacgccaacgtcaacgcccgcggcacgctgccaaagctgtaataacaatattgctggccaacttggacaaccagaaatcgccgcttggtatcaatatgggcaatcaccccagtatcaccgttggccataatcgtctcccgccaacgctttgtcccgaattcgtcggtttgctgcaacccattttcgcctaaaactgcacgccgctcccaagtcttaggatcaaccagcgccacatgcttgtcattttttaaaatcatgacgcgatcacgcattcgcaaatggtgcttttgcttggtcaccggatcgacataactgctgacgtattcttcctcaccaggcctggtcggattgaccaaggcctgcagttcggcattaaatcgcagtcgaccagtggcgcccacatttttattcacaattaaaagttgcgagtccagctcgtggccgcttttggctagcgcgtcttgatacgccttgattccggcatcgaaaacgcggccggcatcgcgctgattgtaaagcgccacattaccgctgacatagcgatcatcatccggtccgaatggtaatggcagccgatcccgaattcgattggccagcgccagcacccctgattgcgcatcctgacgataaacccgcgtcaaagttgtggccgccacctgcgaatcggctaaacaatccttcaaaaagttacccggaccaattggcggcagctgaaagacatcgccgacaaacaacatgtgtgcctttttgaaattcacgtgtttcaacacggtataggccaagggcgtggttaacatcgagctttcatcgacaatgatcaaccgcgcatcaccaaatgtctcccaatccgactccgcattgaaccgctcaagctcctcgcctggcagcaagtgcaagtacgcgtgaatcgtggcggcaggttcgtgcgtatacttcgccaacaccttcgcggcccgcccggttggtgccagcaacacacttttccccttcgcctgggcattgaaaaagtgaaccagcaaattggtcaaccaagtcttaccggtgcccgcactgccattcagcacacttagcccatgctgattcacattctgaaaagcagcgcgctgttggtcgttgatgacgagctgatggcgatccaaaaattgatccagtttgtcatccagttcttccggcttaatcagtggctctgcggttttctgtgccaccgtcattattttggccactgagccttccgtggcaaacatatcgcagctggtcaccaagtcatactgttcatttaacaaaaagccatacgccaacgcctgtttaggatcggcaaacatcgtcaggtcttcggcgcgcacccctaataacgtggctgcctgttgcttaaaccacgtgatcgtaatgtaggtcaacccttgcgtcaaaaccgccgtccggaaaatatactgcaatcccgcagcaaggcgatgcggatcattggccgcaaccccaagacttttagcaaacgcatccgccttcttgaaatcaaactgcgccacttgcatcagcaaatacggattggcatcaatatggtgcatggccaactcagcatctttatacgccagccagattttctcatacgtcatcgaactaagcgctttacgccagtgattggccagcaccgcgacctcaagtttaccgcgaatggccgtggcaattttttggatcgtcgccggcccgatccccggaatccgcgcatccttaatcgtggtctttgaaaaagtcgccaaaatcggctcgtcgtcggcaaacgcttcatgtaagcggcgtaaaaccgtgggctggtgcacgagcaaggtttcaagcaactgccactgacggcggggttctttcggtaagccaaaatgcagccgcgccactttataagacggtttccgatagcgcagtgaatcggcatcatcataaaccaaatcagcagtgataatggcgcgccgattgtaataacccatgtcgccggtcactgtggcttcttgtgtgagcgtcatcttgagcgccggattcgggttcaaaatccgcaccgcgtaaactttataatcgctgctatcactgttgaacaacaacttaataatctgtaggtcaacattttcataaacctgagtctgtggcaccgtgcaccaacctcctctctaatatatttcgcgttatcggtcacaattgcatccgtaatttagtcgtctcatgggtggcagcccgattaagcttggtggcaatacgaaaccgaaaatccgatggcaagctctggagttgctgctgcgcccattgttggataaacgttggctgatgccgcggctgataaaacgtcaagtcgcgacggtgcgtactgtacacaaccacatctccccgcttgtgacgtgcggtccattgcaaacccgccaccagcgcgatgaggcccgcagatggtacatagaatttttgcgccggtttgtaatcatcaggcgtgagttccgcgtttgccggggcatctgcatacgccagttccttgatcgcgtcatccaaaaactcggtctgccgcaacaacaactgatcgtttgcatccgtaatcttaaggccgaaccggttgccatttaaatcattcatccacgccaaatagaccttcgtttgcggctcaaaatcagcatggtcagcatcgtgctgtaagttagccatgccgcggtggagcaagacgcctttcgtggtagtgccatttggtaaacgaatctccggttggtgctcagcagcagccggctgtgaatttgtatgattggtttccattatatgcctcacttctaatcgtaagcttacccggtgcaggcagtgactgcaaaccgccctcaaaacggttgtgcctattgccaaaaaggttgcagctcacggtttgtgaaaaatttgtcacttttcaatttgaatcgctatctaaaaccaattaatcgcagtaaatctgctgtataccagttttcaagggcttgagacaacgcgtcaaaggtaagccgctcgtcttatcatcaggcagcctaaaaatttgagcatgtcaaccagaactgattagtattttcatataatcgcgtcattgcctagtctaacagtgaaagtctcaaaatttggcagtttttttcctaaaaatgagacaaaaagctctttttggaggagccggaaaattgctcgtaaagattaatttaccgaaaaggttcataaattaaccttttctgctcgtttgtgaattctccaaatcaattttctttgtttcccggaatatccggctacaattaaaagtgttccaaaattgtttcatacttggcataaagcgcttgccgacataaaggcttgtaactgcaagttttgccggctcacgctcaccataacgcgttcgccagcccagatacctgcgtgtaaggaccttggtcgcaatggccaaagcccggccatcacgcccaaggccacttacactccggcttctgatcgggctggctcacgctcactttaagtctggggggactttttatgtcaaagaaatactggatcggcagtgtggcttttgccggactgcttgttgggagtttttcagctggttcactggttttggcagctgatgcggatagtgggtcaaccaatacatctgtgaccgtcacgccgggttccattggactttcggcgccgaatagtttgacgtttccaagtctcagtgttgaatccattgtgaaaggcgatctgaacgaaaacgtcaatacttcggatagttccattttgaccgtcagcgattttcgtggtaccggcagcggttatagcgtcactgccaaggcttcaccgattgcgaccagtagtggtgcggagttgaagggtgcagtcatcaaactcgtccctgacgcaacaaccaccacgaatagcgtgtcaccggagtggacgaaaccagtcgcattgaccaccaccgaccaacaactctttgcaactacaaccactttggatggcgctggtattagcagctatgatctcaacaagaccacattagcggtaccgcaagataataccgttaaagccggaagttacagcggcgtcattaccttcacgctcacaccgggtcagccggctcaagctgcgaccgccaacccaaatccgtcttagcacgggaaataattaaccttagattgcgacaccacatcacccccgatgatcaaaccgggacagaaaggaggtgatcgccggcaatcgcagtgaacacaacaaactgtctcaagcgttggcggattctgatcacatccgaccagctgcttgcaagaccaaaaccagccgatctgatagtacaagtatcgggtaaatttccaccacgttcctagtcaaccatatcagctttggggagctgcatgttggctaagaataaagttaatgatgtagcttaaaggcgacctatcgccatcatccgtgacagccaagttgcgacatgtctgatcgtactgtcgtcaacagagcttggtttgcgcacgcctgagacgcacatagtcgattaacgatcaaatcggaaacgatcataggctagtcgcgtcaagtatcaaagaaaccgccgataacaagtcggcggtttttttctaacctttttgacgctcacgcaattaacgctgcaccatggccaaacgaccccggcagttgaacttgtgccgaggcaaatttggcggcgtggcttaacgactcggaaactttcgcgtctagcgttggcttttgcgacgaataaagtgtggcagcaaagcacgtgatatacgcatcccctgcgcccaaagcatccactgccttaacgcctagcgcctgctgccaagacatcatgtccgccaccaacgctgccgacccgcgaagcccgcgcgagcaaacgacccgctgacaaccagccgcggccaaacgccgacacaacgcctccacatcatcatccgacttggccttccccgacaaatacgccaaatcaatctgtggggcaatctttttgaaaatacgatcatcgtcaatcgttgaaaaatcgtaaatcgtcggtgccgtgattgcagataaaaaggcatccgcgccactttcattattaaggtaaacgagatcaaacgtattaatgtaagcaatatcgtcgcgactcagttgaagttcctgaaccggctcgccaacgatttgatgccgcttgcctgtggtgatcttcatcgtggtaaaagcgttgggaccgtcatactgtaacgaatggctaaggtcaacgccaagctcaatcaatgtccgccgcgcaaaatcaccgcgcgcgtcattgccaaacgtcccaagataagctgaatccaagcccatcatggtcgcaaaagccgcggtattcgcagcatggccgccaagaaacattttcttgtcagccggataaaggtcaacaacattgtctccgatcgcgatgattttcaagtgccgttccttctttccatcatgaagcttcgccaaggtgttagtggtaaccaaacagactacaatcaccaattcaagtttaccacaggtgtgcaagcgagaacctggtacgctgtccgtcccaagtctcgcccgcatcatgacagacttgtataaaaaaggaacgatatcccttcgtttgcttggaaataccgttcctttttaacttgcaacgatcacgatttgtctaggctttaactagcatcctttaccgtgtccgccggtaaccactcaaaagataggtggcggcgctggcgacaactaggagtagtcctaagatgccagttgcccagttattttcaccggttgcagggagttgttgcgccttcttcttactttcggatgccgaagtacgactgctggttgtggcatctgcagctgattgattattgctgtcaactgagacgctagagcttgaggcgactgaagattgacttggctcaataactttactggaaggctggctgctggcggtactgctgcttgaaatgtggctgctcgtgcttgtgctgctagtggtggcgtggctgctgctcgtggcactgcttgagctgccagcagatggttgactgccactttccgagccgcctgaagtggttttatgcttgtgcgcagtaaaagtagcttgatcaaccacactgccatccgggtgccgcactaacaaagacatcttatcgccggtcacatgcagtgtcaggtaaactttttcatccttgtctttttgaacgacttgccacacagcgggctgggttggttgaatctcataagtcttatcgccggtgtggccggtggcgatgtagaccgtgccgtttttggcttgcttgtgattaatcagcggataggtgcggccgtatgagtgatcgtggccgtttaagacgagatcaattccgagttcgtcacaaactggtgccagcatatcatggaacatcaatgattgagcatcggctgggttcttgttgtagaccggctgatgggtgagcacgattttccacgtcttctcggtcgcctgcatgtcttgtttcagccaggtcatttcggctttcattgtctgctcgttatctgtccagccaatcactgcgatatgcatattgccataatccaccgaatacgtccctaacttgttagcagccgggccattggtatttggcacgccaagcatctccgctgacttggaaccatcatcacccatgtactcgtggttaccaagcacatgaatcatgtccagcgaatcaaacgcgggatgctgattaaacatttccgcagtcttatcagcttcggaaaagacactctggtcatcgttaaaatcaccgacatgaatcgcaaagttgctggttggcttggccttttcaatactgctcaacaccgtactgaaatcgtctaagccagtatcatcggaaacttgagtatcgccgaaaacattgaatgtgtaatcactgccgccgtgaagtgtggtgaacgtgcgcggcgctgaccaattggtgccatctccgactcgataaacgtaagtcgtggccggctgaagccctgtcgcggtggccgtactgaggcggaccgcgctgctatcggcagaataagtggcaacattagcgcgccctgttgccattttaaacgctgcagctccttggtctttgtacgcggattgcgttgcgacttgcaacaatgccttgcccgttcctgccaccggactgctcatccaagtgatcgtcttggcatgttccggatcctgggtggcaccagctaaaagattcgtcggcacggcagttttctgggcagtgtaattctgcgtagcgactggaaagctgtaaccgtccttttccgcttgcaaggcaaacttgccaacctgttgcgtcagcgcttgggtcgtcagctgccccgcatgatcggtggtcccaagctcagttgttttgccatccgcgttcgtaaccgtaatcgtggctgaggaaatggctttatgctgagcatccgtaactttaagtgtggcgggttggccgataatcaaatttggtgccgtgagttgataggctgcggtaacgccaactttagcttgcggcgtactgaaggtaccagtgacgtcactggcagatcgagacgtcacttctccttgcgttagcgcataggtcaaggctttgtccgcggtagtactggctggaaccgtcaccgtaatccgcgctagatcgttttgctcgatgttggtcagtttcaacgtcaacatgccagtgtttgcgtcgtactggtagctccctgtgttctcaccaaaatcaactgtcttcacgggaaaaccggttggcagagcaatggggcttgtcaatgactgtgcctgcgttgacttatccgctttaaacaccaactgatacgtcccgcctaatttcgccgttttcgtcaaaccggtcaacgaaaagccattctgagtaccggttgctaccttgaagtccgtttcacgatcggtttcattcccgaacttgtcttgcacactgactttgacgtgatgcgtgccatcgcgccacttgtaaccagccagcgtgaacgttccgtctttgtcgatcgagtagtggccttcagcgttcgtgtactcggtgccatccacccaaatacgggctttggtccaatcaactccggtagcatgcggatcgctggtatcatcatgcaccgcggtggtaatgctgacttgcgcatttttataagtctggttggcaacgttgatgctgctgataatcggcgccttcaaatcgtctatattcgtgccatataccgcccggacattatcaatatataagctgcctttagtcatcggcccgccatctgtctgaccggacttcagcgacatcatccgaatcatttgttttggaaaagtcgtgaacggcccttgataaccggcaggaatcggcgcttcgacatacttccagccggtccaatcaatccccgtatcctgtggggttaaatcaatcggcttggccgtcccggtggcatccgtcacaaacatccgcaaccagtatccttttgcttccggtgtcgcataaatccacatcccaattcctgtgggcatccccggaatcggtttacttgtcgctgggccggcataaacgccaagggtcgcactcttggtcccatttgtgaaatcgtaatccagttttagcgcgtgctgcccaaagcgaacctcaccatccgtggctgaactcaagccaatgttggagacctcgccacgtccggcagttgatggcgcccagtcgcctaagccggattcgaaatcgtagagaactttcggcaattggccaacctgaactgtcatctgggcattgatattggtacctgttacagtggcttttacagttccgctggccatggttttgcttgtctgcaattgattatccgccgtcatagtgccgagttgactcggtactgaccattgaatatcaccggatttcaaattaacaggtcgtccctgataggtcgccgtcagtcctaagtcttgctttgcccctagtctgaggctcaactcattttgcgaaaaagccagtttatcaggttggaaaatggtaacggttgcagcacctaatactttgccatcgagagatagctgagcagtcacgtcacctaatttgccattcgactggaaaacaccagttgctgaatcaatagtgcccatacttggatccttaagctgccagattggtccgctacttggcagaggtgctgcattgccagatgcatcaacacctttagctgagaatttgacgctactctttggcgtatacacctgatcatccggtgccaccgttgcactagctaatttatgatcagcagttgccttagacacaatcaaccatgaattcgccactagacgttcattgccatctgaaggactattttgaaccgtcaagctcgtgtccccaggttgccgtgccacaaaagttgctgacccgccaccgtcaagaaaaagtgcgttaactgccccgcgttctatcatcaactttgcaaaatcaccgacagaaataccggttgaaagcggtgcctgtcttccatcaataacgacaaagaaaacggtaccgtccgctttaatacccaccgccgtgcatggctcattgccttcacttcctgccacttgggtcgcattaaccttaccatctttaacaaagatactcggcccaccaacggcctgctgcaaatctccttttctttgctgataagtggcagcagtgccaatcatgggtgtgccatcctttttaattccgaaaaaagcctcattcgtgtcaggtgccgagtaaatttcagtcccatttttcaccacattgcctaagggagcgcccgttgccatattgtaataatcggcattcaccgctgccacaacctgttgaccatggctaatagccgcatttgcttggttccgaaccgtctgcattcccggcttcgtgccatcgtttggcatccctgctagcaacgttgtattcggattcttgggatcaagcgcaaccgagtaatacttattctgcacgccattttgattcagatatgtaagcttttgttcggtaatcccaggcgctaaagttgcttgctgctgcccaataatcgacttgatcaccggatttgttgcagcagcctgtgtgttgttaatcgcggaagtcttcccgctggcagtagtggcgctactagccttctttgctgtgtcagcggcttcttgactagtgctggtttgcactttggcatcagttgaattcgccgcactcgatgccgccgatgcagtggtagaactcgatttttgggaggccgtcgcagcagcgctcgaaaccaccggcgtatccgtcgccgtcaccgcaaccaccggcgccgcaacctcgccacccatcaaagccgccatcaacagcaggctgccaaccaccgtccatcttttcctaaccatccgtcatcctcctacatgtaaaatatgattgttatcgttgtatatcagtttatttatacctaaaggatgtaaagaggttgtggtggttttgaaaaggttgggtattggttgtgtaaagtgctgcgactcatactatgccgacctgatatcagcgaaaaagcgacaaataattccagcaggctttgtcaaccgccgaaattttttgccgctttttgaactaacccaagtctgataacgattatagagtttgatgatggttctcgtctgatcgaaagattactcaatatatgacttccttgatctcaggttcttataactcaaactttgtaagaaacttttcagaatcaattttttcgaaatcttttttcctaagagcgattatcttgcttaacttgcctgtgggtgcgtcaataggcaaacacttcgcaacttcagagataatgacttttctatcatcaatatcaacgaacttcaccaaatacccagcatcagtcaacgataaaagtttgtaaatggcaccatcatagcggataaatgtaaagtatggattatatgccttaattgctctatatgcattaataactcccaaaattgccacaagaaaagttaccagagctccctcgtgcatttcttcacttgagtcgtttgaggtcacaatatttacaatagctatgatgaatgataaactcgcaaaaaaatgcaaacgtaatcattacaaaaacaatgattattgtacctgtgcttcctaactggtattttcctttatttaaaacggaaaaacgatcatctccgctaaaatgatttaaactaaacccaataagaagcgagacaattgaagttaatatattttcaaacattttttcacctttcaacatttagaaaagtcttgaaagtacaggacatatgccaacatacccgcctgattctcgaagaatttttactgatgctatctttatttagccaaattacccacaaccttgatcttcactcgattagcattctccggatgatatgccaacgggacctcatcaacttcgacaacttcaattgtattttcatcagcaccggattcaatcgccgcttcaatcgcttttttcttggcgtcagccattgcctgatcacgcggaatttggttgtaggggtagatgcggccatattcaccggaaacttgactaatggaggcaccgatcgcattggccacgccgccgaggggatcacgtactagtttgccaacgccttccaaatgatgtggggcaatgatcgcaccgccaccgactagtacaacggtcgctggctcagggctggttttcattttgtcaatggcaaccgtgatcatctggccaatggtggtcatcgcggcctgggcaaattttagcggaatttgcttgaccagttcgggattgccgacatcggacagaccgagccgcacagccacatctgtcgcggtcacgatattaccgccgaaagtcagcgctttttcggtaatctgatagccgactgaatccggaccgactgtgacactgccatcgcgctgctgccggacgatcgaaccgccgcctagcccaatcgacataatgtcaggcatccggaagttcgtcgccacaccacccacggtcacggcaatcgaagactcacgcggaaagcctgcttgcaacaccccgagatccgttgttgttccgccgatatctaccacgatcgcgtttttaagatgcgagagataggcagcaccgcgaatactgttggttggacccgagccaatggttagaattggaaaatgccgcgcatagcttgctgtcatcaaggtcccgtcattttgggttaagtacagtgatgcatgtttaatgccggattcagccagcgcccgctcgaagccatcaacggtattttcaatcacgcgaaacaagccggcatttaaaattgcggcattttcgcgttcgattaaaccgagggagccgacctcatgcgacatcgtaaccggaaaagtatcgccataagccgcatgcaccaaatccgccgcttgttgttcctggtcaacccgcaacgccgcaaagacaccgataattgcaatagcgtcaacctcaccgcgccattttgccaatacagcattgatttcatcagggtcaagtgcgtttaagacctgcccatcatattcatagccacctttgacaatggcatattttccggacaacttggcaaccaagtcttccggccatgcagtgtacggtggaatagcttccgttgcgggatacgccaaccgcaacactccaacgcgcgcaatgtgcttgcgttccacgatggcgttggtgatttgagtcgtccccaacatggctttattaatttgatccaagtctagctgctgatccgccaaaaccgcttggatcgcgttcgtaatgccggtttgaatatccctagttgtgtgccgtttaactgaattgatgacatgttgctgatcatccaaaatgatggcatcggtattggtgccgccaacgtcaattcctaatcgatacatggaaatccccctatttgtgagtgttcaagtcagtgcggaagaaggtacttatccgccgctcatcaaaacctcagtccgcctttgccaccaagtcttctactggctgatagtcataatcaaagccaaaataccgcggccctgctgtttgaataccggctttggtccgccaacgcgcatcggcaggggtagctaggactttgacccgcttgccatacttaatcacttcagtcgtcaccggcaaaagcgtatcggcatccacaatttcaatcagatccggtgtcatcacaatcggctgatcattacgcaacgccagcaggttttcattttgaattaaaacgctgagatgttgatcctgaaagtcattgaagccatcaatcttaatatcaccaacgttaaagccgcgctcagtccggcgaaccacatcaatgaccttaccttcaaaaatcaaatgaccactcgtcacttcaagaatttccgccaaggccttcgcaggattcaggtgggcatcgcgaattcgcaagcctacttgttcgcacaaggtgacaatgccgcgaataccattttgcttaatctgcttgccgttcgaaggatacaacgctactgttgcgctaccacccatttccacagtttgtacacgggccaatcgctcagcccacttggcactgatcgttttaatcacgccggcattacctttttcatccgtaatgaccatcggcgttgctgccacgccgcctaagtaaaacgtcaccatctgcaactccggaaacgcgcggcccatcccatcgcaatccactagtggaattcctagcgatgcggccagcgcaatcggcaccatcgaattcaccccgccggcctccatgggaaaagttcctacaaactcatgaccggtatactggcttaacattttaaaaacccgttcaaactcatcacccttaggaatcttctccatcatgaccgcgggcgcacccataatcgctgctgggcaaaaataatcatcatcgttaatttctgaaacatcaagcaacttcaccggtccgtgctttttaatcgcatcaagggccatcaatttacccaagaacggattaccgccaccgccagcaccgaaaaaagccgcgccggtcgctatattttcaatggattcctgatctaaaagtcgcatattgttctccttttaaacttatcttcagtccgctaagtcatacgagtcgcgcaccaacactgggctaaacaaccgaaagtggattcttttgggatcaccttggtcaatgtttgcctgctagttcaactctgatgctttgtcccattctggatgaatctttgcgcctgcataatacaggacaaacgcaagaataatcccgagcaccggaatgtttgggatcgccggccacagcacgggcagcacgccgatcaccgcacccagcgcccacgcggtcaagccaagccagttcactccggcgaccggctgccagctatgcatctcaccacgatgaatcacccaataagacgcagccatcgctccggcaaccggtggaatcatcgctgaaaagatcgtcatgaccggctcaaaataatttaaaatccccagaatcgacaaaatcgtgccgccgacgcccaccaagaacagcgtcaacttgcgatatttctccgggatgttgaaaatgtttgccactgcaatcccgccagaataggcattcacaacgttcactttccacgtgccgagaataagcgccagaccaccgataaccggcgaaccgattttcataaacaaactactaatatccgtcgacttaaacgcaatcgtcaaaatcgcgccaatcgcaatcatcaggacaccagcaggaataacgccaaaaatagcagctttaaccacatcatcgcgctttttggaaaactgcgcataatcaccgacaatgacgccggccatcgcaaacgacccgactgtagaagaaaagccattcacaaacgacaagctgccactgggatgataagccgcaatcgttgccgccgcgtcctgcttggcaaatgcgaaccacaaaccatataaaatgacaatcaccagatacggaacagcaacatacgccaatagccgaatcaacttcacgccatacatcgcagtcaccaccatcagcaaccccgtcagcaatgaagccaaccacgccggaatcggcaatcccacatacttcagcaaattcgccacggccaaaccgccaacgttcgcctgaatcccaaaccagcccaacgccgcaatcgcgatgataatcgaaatcaccttcgatgacccaaccttaccaaatacctgctgggcaaccaccaccgctggctttccttgatccacactctgcatcccttgagaaatcatcatcaagacaataaagccgtatcccgccaatcccgtcaaaattgcaactggaagcgacatcccggaaaccaaactcccgcctaaaatcaagctaggaatagacaccaaggcaccacataaaatcattgctaagccgaaccatgtttgatcgcgtttgttttcttccatactgggcacctcacatatttttttaataattgcagtcattttggccgaattcgatggttaaggatctaactcgaccggaatgtaatggtttgattataaaattatgagattgaaagtcaacagtttcatttaatttttatgaaattccagtttgggaatattcgcgcatcatttatgacaagtagttaactggcaacgctactattaagtctcgtgttttcggcttatgctcgccaaatcgctattaactcgtcccaaaaagtttcagattttatatggctccatcaaaaaagaaccatccactcggcacacttgcaccagcagacagttctaccccaactacaacaattattcgctaatttcaaaactttgaacggtccagtctctgaacccagacaactaaactattttacccatgcaaatgactgcacacatctgaggtctcaccccactatttgccgaatcgccaaaagcaccaaccccgccgccgtgacggtcatgacaacattaagcaccttagacgttatacgccgctcgcgctcatccatatcctcaatcatgctcaaactatagtcattgtaaggcccggcatcccaataacccacataataactcaacagccgcttctcacgattagtcagcggctcaccatcatcacgaagcaacaactgatcgtcaaacaacgcgtacatgtcatcgctcaacatcgccgccttccgatcccgccgcgcctgctccttgacccacgcgtacaaccgtcgaaaccgcgccaattcccgctcatcctcatcattcaccggcacccacgccaccagtttccggcgaaaaatcgccatcacatcgtcaaaatgcttacgctgataccgattgccaaggcttaaataacgattctgttcgttcagatattttgtctgccacgtctggtaaatgaaaaaggcaaacaaccacagcgtcatcaacgcattaataaaattgccaagattccaagccgtcaacaacttctcaaaactgccaatcacccaaaaagtaagaatcatcaagctgacaaacaatgataacaactgtttctgccgcagttggggattccgctgcatttcggcataaattgtctgccgatgcttcagatacatgacaaaatagtccagaaagtctaatgaacggacttggcgatagactttgacaatgtagataagcaggatgacaagcgaaaccatgttgatcacgcgattgatggtgtcgattgcggacattgaaagctcctttcaggttattggcgtagcgttgcattttaaggtgcttcaattttacctgaaattgggttaggcaaacatctttattttagtcatgattaacagttctaattttcacattaacatcagataaatcgtaatgattgcctaccaaaatccgtttaatgtgctgaacccgactccaggcactatccccgcctgcataaacggccacatcagcgtctcccaactgccgatacttctggtcagcctccacttcattcatatgcttaactaagctatcatcactattcgccaagacaaaaaagttcgatgggtccgcgtcccacaagagatcaattaattgattgtaaagatccgtccaacttttgactgccacaacttgataatcaccaaagctaaaggcgaccggctttgttccggtgggattggctgcaaagatcgcatccaacgaatcccacgtactcggatcatcgctcgtcacttccacatcaacttccggccgcggccaaaccttaagcgcccgcgccagcaagtccgcctggcgcttttgtaacgttgcttcatcccaatgatcaaactgtgcgacccactgattaagcttaatcccagacttgcggtagccgtcagccatatcgcgtttatcgataaatgtcctgttgctcatttgcccattgaatcccgtcagcgtaagatttgccaaccgatttagccagatattgtgcgtcagtcgccaatccggtcccaaagcattatgccaactggtattcagcacctgtggcatgatgtgctcgatcgaatattggccatctgccgcagcctcaaacagatgctgcttttcaccgtcagcattgttcaattcgtccaaaatgaaccaaagtgacgccgaactcatgtggtaataatccttttccgccaatgcttctctcaatgcctgatcagttgggaaacgcttattatctttaaccccttgtgtcagcatcaccttcaatgcatcgacatagcctatttgtgatttggccatcatatgttcaacctgccgatttaaagctgcaaaaagttgattcaaccccgttgtcgggatcccgatgaaaagccgccgcgccaaataagccaacaacacctttaacaccgcaactaaatcatctgtagacaattccccatcgcgcgctttagcaaaaacttgcaacaaatacggcgccaaaatgtcattattcaaatgtcccaaacgaatcagaaaccctcttacccgagcatcagctatctccgctgtttctggcgatgtaatctcggcaaagagtcgagcagcagcacgctcctgtttcaactgcgcaatccgatcaaagccctgcgtcaaaccaacataacggcggtagtcactatagatttcgtcttctttaaccggtttggaactacgcgctaaagaagttaaatagtgccggtaaaatttagacagcccatcactacctaccaaatgttcattttgttgccaaatctgaaaggccgcagcttgctgatcaccttttaaccccatcaataaaaaatttcggattttatcggattccgtcaaattcatacccgtagaatttaggctttcaaatatcagctgagcatcatcatcctgatcgacaacaatgtccatcacttgaagtcgccgctcaagcaaatcaagccattcatgtgcgcttaaatcagcttgctgcaaaacattccaaaagtaggcataggtcgttttaaaaatcgtgtcggcagcattcattccgttctgcaaaacgtcaacatattgctcctcgtctcctggcaccggatgaagccgatttttggcaactgaatcatagtcatacttgttaatcagaaattcttcgttaattcgttcatagttaggatcgtcattacccagaaaatctcgcacagcaattaaaaacaaagaaatcgtcgtcagtcgctgttgtccgtcaatgaccgccacggtgctaatgccactcgttgcatctaatatcaagctacccagaaaatatctttgttgcccatttgaataagcggttttcaagtcactaataagccgctcaagctgttcccgccgccaactgtagcgccgttggtaaaccggtatgttaatggttttgttgtttgcgattgtttcgctgacgattagatctgcattacccttcatgaattgtcaccccaaagtgtttgattgcgccaactagagacattgacaacccttccggaatagttgacggttaatctcggcttaattcatcctcaataaataaagtcaaaccattctctgtatcaaagctgttcattaaaagaccatctgccccaaataaatttcactagattcagccaacccccagagctttaaacgctgcatccttcacagaattgtaaaagattaaattaaacgaactcatgagatcagtcggcacactgctgatgtcactagctgcagcagctggcaacaaaactcgcttagcaccactatctaaagctacttgcagggtgtctgccaagtcatcgattcgcgaaattgttccaccgatcgtgaaatcccctagaatgacaagcctatcaagtgttggttttcctaaagcgatggaaacaagtgcaatcagtgttgctagtgaaatgtgactagaaggtgctgaattgtttagattcgtcgcactgacgaagaaatcccgtgcatcggcattaattctttggtcaattgatttgtaattggcttcaagataattaaaggcggtattcatagcttcttttgcttttgtactagagccaacacctgagcgatttagccttccaagtcccggtactgtctgcgtttctaatttaattaagcttaatcgcttgctatcatcgtaggccactgtataaacatgccccggattctcttgcccttccggaataagtgaacttgagcctgactcaggaacggaaacatacttctcctcaaacgatactttatcaatatatgaaaagttaacatcgtagaattccatgccgccaactcgtttcagctgctctttaacgcgtcttcgcatctccatcgcaaattcaagaattttggcgacatcatcttttgtaaagacgccatcaggaaataaaagcttcactagtcccgaaaccgtcgttctaacagcgataacatcacgctggttcaactgttttccaaatgaaaagtattcatcaatggcgtcagcatatgaaatcttccgtaactcacgcataacctctgcaaagtaatcggtgatgaaaccaaagccctttgtaaagaactccggacgatactttggaatctcccagccgggtaggtaattatgaattcgatcaagaaaggcagtatcgttacccatcatctctggaaatggttcaaacagatttgatgtccgcaacaaaacatcgacactttgattgatatttcccacaaagaccatacctgccgaagcttgaatttcgtttcttcctctggcaaatgatccagaagccatatagtccttcatgatctggacaccatctttatctttgaagtgaattcccgccacttcatcgaatgcaacaacatcccacatgccgaccaaaccaacctctcgccgcgacatattgtaaaacagatttgcaactgtcgtttgtccgcctgatacaagaatggaatccggagagagttctttgtaaacgtgtgacttaccagttccacgaggtcccagttcaacaaagttataattattttccacaaacgggattaagcgtgacaataacagccatttctcgcgttccgtgaactgagtcggctccataccagttgtccgcagcaaaacgtccaaccattcatcagtggtaaatgccttccgtcccgcataaacttccttcatgtccacgaagggtacttgaattggattcaatttctgaatggaaaaatgatcgagactttcatgatcatagctaacgcgcacaattgaccatataccgccgattaacagacgttcataatcttgtacatagcgttcatcaacaggcacaccggttaatcccagattactaaaactagcctcgtaacgatcttcaccttcattcaaatgaacagtgagtttatcaatgaccgtataggcgccatcttcgcgaatctttgacttaaccttttcggcttcatcagggcggacataattatgcgctaaggtcttcttaacattttcaacgccgcgctcgatcgtctcctcatctgaactattagcgaattgaccaagcaaaaactcgagaacgtaggttggcacattagccccttccttaattctctgagtcaagtcctttcgtacgaatcgtccgggaaagttttgttccaacttgaccaacacttcatcattttttacggaatcagcttgcgtgtcatcagatgtcaaagtcaaaccctccccctacagtgagatccatttgatagtcgattgaagttgttgtattcgcctcaacgttttgaatgattagctgatagtgaccagcgcgatcaaagtcttgatcaatgagcgggatatgtttacgaatcagccgatcattaacattgacggacgtactatctgcttggacaacttgttcaccggaaatgtgccgcccactcccatctacaaagtacagagcataagtagctggtcgatgtgtctcatcaacagggtcattttgcagcatgttaacgatcacctcatgactcgtgatacggcgggtggaatctgtaaccgataacgtaacataggttgcctgcgactttctgctttccgtcaaaacatgtagcactggaacgatcatttcttgcggagaacagccaccgtggacataattttgaccggctccagggaccgaaaagacattcgcgttgcttggatagaaaaccattcgctcatcgtcattgttcaagatgtcccctaacttgacacgaccaacaccgatttcgtcaaaatcctgtgaaccaatagcataacgcaggttcttctgctcgaaatccacctcagccggcaaactgatcttatccgttgaatcaagcaaatgccgccgataaataaacccgtgatcagccgttacataaatatttcgaatggaaatattacgtaaccggtcaattgcgcgcgtaagttcttcaatcgcatcatcaactgcacgaaaaacgttcgtttcagatgcgggcttatcaccagttgcatcaacagtatcgtgataaaaataaatcactttttggttaacaatatattttttctgatctgccaagctcattgagataaaatccttcaaatgcatggcccgactttgaggctctaaagattggagaatctctaagcgttgttctaggttgacagctttcttaccgtccaccaataattccttgtcgccttgatatgtcagtttctggttaggcaacagtgatggcatgccaaagtaagtgacagaaggcacccccgtgatcgcataatgcatgtcggttccgaaaacatcgcgcgaatcaaggcgttcttgaagttctttagccgcctcaaatcgaaaagcgtctgagatgattactacaacccgatctttattaggtgctacgacagaagaatagaagttccgctcaagggttcttggctcaactacatttggcacatactcttggcaccaatcatgaatcgttggagcaagatggtcattgttatacgcagcttcgaccttctgtgacaatttctcaaacacttcaacttgcgacgtaggcaattggtccgaagcattcgtatatttgcgatacgcggtgtcaatcaaataaccgtcagtgatataagcatgaataagatcatctaacttgccagtatcgtgaatttcgcgtttcgtcaaaatgctgtgggcctgaacgaccatactataagcaagttgattctcttcggcaaaatacatcctgcaccgttttccagcaatctcaggcaagctcatttggtcaatcacttcaccaagatggccttgcagaagctgttcaaccagccactgtacaacttgctgatcaaactgaataaaagtatccgtctttaagcgttcagagatcttcaagttcttgaacaattgatagccatcaagttgctgccaaacgtctgtggctatttttttgtaaaccgctcgagtatcccttcgattacgccaattaagcataaaggatacgacattattgatataactgacctcatagctttgaagacttgttggcaagtcgagctccatctgataataggcaaagttaatcatcattgtcgccaatagatcttgtaattcatgtttgccgtggtaaccatacgcccgatcgacaaaactccagaaagttggcaacaattgatatttgtcgaatccgtccaacaatgccggattcttgataacttcaatcaaaatgtttgaaagctgcagatcagacgtcttagcaattgcggctaattccacttgctcgggatttttgccatgctggtaacgttgcttaaatcgcgcaatccggggctttgcgccaaaaaacttacgctgatcttcaacaaaactaagctcagtctccggcaagccaagctcatgcagcaacataacattcatgtctgctgtaaacttcttcgaatataaaatcatatcagtcaagagattttggtgaatatcgggttcggcaaaattggcataaacaagcgccttttcaccagcttcttcaatctttataagtttgagtttcgtctttaattgcgtacgcaccgccatcactacgattggctcattcagttcttgagccaaatcatcaatgttttcagcaaactcaccatttttgtcataccaaaagacaaaatgtgtcccgcttttaaacaatttctcgatgccagtgacgacatccttcatctctacctctgccatactttatctactcctaattaacgcaccggctagtattctagcctctagtataactaacagttaaagccgtggctataatcctactttctttttgttcactccaagctattcggttggggtcattcgtgatcttgtggatgatattcgtgaagatgattttgacgtggacaagggcggtcaggttgagattattgggtggctgtatcagtattacaataccgagcccaaagacagtgcctttaagaaaaagaagtatttgacttctgatattcccccagtgacgcaactttttacgccagactggatcgtcaagtaccttgttgagaactcccttgggcgatactggatacgcgttcttcttgaacgaggagataagcgtacttctgctgagattgctgaatcatttggatggcactattttatgccagatgttaagcagaatgattcaacgccttatcccaacatggccaaaaaacgaattgaagacattacttttgttgacccagcaatgggatcaggacatattctgatctatgcatttgatgtcttcttgcaaatttatcaagcagaaggctattcgcgtcgtgaggcagctcaaaagattgttaaagacaatctttttgggtttgatattgaccgacgtgcatttcaactagcctattttgccatgataatgaaattgcgtcgtgaaaatagacggacttttgatcttcatttaaaacccaatatttttgaggtcccaactacggccttaactccagatgatttttctgagactataaatgcaagtaaaacggacaacgaacagttgaaagagtttttaacaaagttcaacaaaggtaaagaactcgggtcgctgatagatttcaacgccgatatctttaaaaatgccctgattaatgagatcattcataaccagtttactggacagctcacgttcgatacgtcaaaccaactagcacatcgacatgagttaaagagcctggttcgggtggggatgggtttaagcagtaaatatacaatcagtgtgactaatcctccctacatgggttctggcaagatgccaaaacctctttcagattttgtcggaaaaaaatatccggcaagtaagtctgatttatttgcagtcttcatagagcggctccagcatatgacaaagcaagatggcttttttgccatgattacccagcaccaatggatgtttctttcaagctttaaatccttacgtgaacggatgattaactggccgattataaatatggcacacttagggacacgtgcatttgaagaaattggtggagaggttgttcaaacaacggcctttattattcaaaagcaagcgagttcaaactttagcggcacttatgagcggctggtcgattttgattcacaggcacataaggaaaaagcttatcttgctgccgttaaagatccaaatcttaagtatgtttatcgtactaaacaagcgaactttgagaagatacctggaagtccgatagcttattgggcgagtaaaccccttatttccgattttgaaattggcataccactcaaagacttagttgatcctaaagtgggtctgcaaactggtgataacagtcgctttctacgtcaatggtttgaagtaaatgtgcataatattagttttaacacaaagagcaccgcagaatcgcttaggtcgatcaagaaatggtttccttacaacaagggtggatcatatcgcaaatggtatggcaattttgactacattgtaaattggcaacatgatggcttcgaaatacggaacttaaaagatgcaaaaggtaaactgcgatctcggccacaaaacacaaattattacttccgtgaagcgattacgtggtcaaaaatatctagcggaaagatatcctttcgacatgttcctgtcggctcattgtttgatgttgcggggacaagcttattttcgaatgaaccttataaattagagatattgttagggttcttaaactcaaatactgcaatggatatattggcctttctatccccaacactgaactatgagattggacaaattgccgcgttaccagtgcttcccaacaaaagagaatttctagttcgtaatttgacgagggataatgaacaaatctctaagagtgactggaatgtttcagaagtttcttgggatttttggtatttcccatttgttgaatacatcgctgagcatcagaaatcacctccagcaaaattcttgaccttatttgagttttgtggcaaatatgtgccaattcagtttaggaggttgatttttcatggtaagttatcaaaaacgaggtaaggtatggcaatatgaaatttcctacaaagatttagacggaaagttcaaaaaacttcgcaagtcagggttcccgcgtaagtcagacgctgagcttgcagccagtcaggtcaaatcgttttatcttgatataaagcaatatcaggccggagccattacactatctgaatactttgaccgctggattcatctctacaaaaagaattccgtcacggcagttacctttatcaaatatgaaaataccctgagccatattaagcagctgttcggaggcattctcctacgtgacctcacacgtaccctgtatcaggaacgactaaatatcttcgcacagaatcatgctcctaggacagtagcagctttccataaacaaatccgtgccgcgttgttagatgcagtggacgaacgaattattcatttagatccaacacgcaaggcaattatctcaggccgtccaatttcggcaacaaagcgtgcactagattatcaagaatggcgacagctcattcaaggactggacacttcaaacacagaacaaatgatcatctatatagcagcagtgaccggcatgaggtatgccgaggtcttgggattaaccaagtcagatattgatcttactagtggcgaaatttcgatcaataaaacttgggactacaagtatcatacggggtttaaaaaaacaaaaaatacatcgtcagttagatcagttgtactaaaccccgcgtcaattatgaaactggcacatttcttggagctacataatccagaatcgtcccaaaccccgatctttgcttccaacggtcattctctagtcagcgcagagataaacaaagtactgactcagaagttaaaatcactcggactaccgcggattactttccacggactgcggcacacacacgcatcaatccttctttaccaaggtgttagtgtcctatcggtatcgaaacgcttgggccatagtaacattacaacgacacaagcaacttatttgcatgtcatcaaggaattggaaacacaagataacgagaaaatcctatccattttgcaagcaatttaattggcacatttcttggcacacaaatgggcgatcaacacagatcgcccatttgtgtgctcatttaagtggcgtaaagatctttgtgtccgcctgtgcctttgcgtgatttaccaagaccccatcatctaagtcaagatctatatgcaaattcgcaacatgttgcaacttttcatcatacttaactagctcgtcaagttgcttggtgatcgttgtaatctgctttttgatagcattcttttgccgagtttgctgttcattcgcttcgaagctcttcaattgatcaagtcgacgctcgtaagcttcttgcaacgggtgaagatactttgttcgaatcatcgccatggtattcttgtcatatcgatgaaggtacattaaggctttaaaaccgccgttccggccagaattaagttcccaatagatcggccgcttctgatacgtcgacaaatgatctttcttaaagaaatcgtctcgaagataggcgcgtattatctcttcggaactgctccctcgcttgcctaatgcgtctgcaatgaactgcacgttttcatcgagatgttcggttccaaacgtggcagacaagaattctttgaaacgatttacaacgtctcgattatctccaaaataatcgtcatcagttaagacaattacgtcatcttcattcggaagaaaggtcttgtagttgctatcatcccagtcaccacctgcataggccagtccaggtgtatcaatcgagtatctaccaaaaacgcaaccaacaaagtacgacataaacgcttttatatcacgcgacagatcggcacgcctgacagacacatctttatcttcttcttcaggactaagttcatcctgtaacccgtaaagatcaatgaagattcggtttaattcttcttcatttgccttcagttggttaaaacgtttatcagcttcttccttccactgattaaacgcagcttcaattgtccaatttcgatgatgctcagcgatatattcgaccaatggagactttgaaaagttccacgagttctcgaatgtatcccaatcatttctcgtaacgtcaacgctttcttttgacagactgttcactctaggatcttgggaagagattatcggcattaagctgacataaccaatgctcgcatgtatcgtcggatttagcaaagacataataaagttcatcactttagtattggaaaacgcaagtattttttctaaaatgtctctttttaatgagaagagtgacattcctaccacatcgaagatcgagccggactctctatacctcatgctgaagtgtccactagttacatcagaccacgtaatcgcttcacggaagtaataattagagttccgaataactgaacgttgcttgccatttgcaaaggtaaaatgctttatttcaaaaccatcatgttgccaatttacaatgtagtcaaaattgccataccatttgcgatatgatccacccttgttgtaaggaaaccatttcttgatcgacctaagcgattctgcggtgctctttgtgttaaaactaatattatgcacatttacttcaaaccattgacgtagaaagcgactgttatcaccagtttgcagacccactttaggatcaactaagtctttgagtggtatgccaatttcaaaatcggaaataaggggtttactcgcccaataagctatcggacttccaggtatcttctcaaagttcgtttgtttagtacgatatagatatccaaccgatggatcagaaacagcctttaaaacgtactttttctgcacatccataccgcctttgaagtctgaaagcttcaggtatgtgccttctgcctcactatctgatttattcttcaaaacaaaggtgttaataggaactgttgcttcttcaaaggctgaatattccatttgaatcaaagtggaaatctgcttcgtgttcaagatggcttttctaagtccttcataggttttaatgaacatccaaacaaacggcgtcatataagctgcatatccgtttgttgcggtcatctcaatattcttccaaatgaaaactgagaaaagatcccctgaataaggtttgtagaatttcttcacatacttcttgagatcgccattcatgcgatttaggtatggtggattagttgccaccacatcaaatttagtctgcaggatttgagcgatctttaggatattgtgaagactatctttagctgattgaagcccaaataaatccagttgtgtggactctggcaaggaatttactgcactaacaagcttatcaaaatcaaattgtttgtcgaagtgcataattgaaccgagtagtttggcttgtttaaaagtcgcggcaagcagttttaaatcgtcaatgacctctttaggagctttcatcttttcgaaagcctcgtttggcacatcatcgactgtttcgaacacatgcagattatggtggactgactcgtttaagatgcgccgactatactgccgagctttcatcattaaagcaaagtaagccaattgataagcgcgcttgtcgatctctagaccatacaaattatgtgccaaaatcgcacttgcggcctcacgttgaccatagccttgttcgatgtacatcttgattagcaaatcaaaagcatagaccaagatatgaccagatcccattgcgtcatctaaaatttttaacttggtgatgtcaaattcatcagttcgtttttcgataggccctggcagtaaataggttaaagcttccttaatgggcgagtcaggaaaatattcaaggtataagcggcctagtgaattgtcaaccatgtaccggacaacccagtccgtcgtaaacagttgggtggcggcagggatgtcgtttgtcttgatgggaccaccattgatgttgactactttatcgtgcggttcaatgttgtaatactgatacagccacccaataatctcaacctgaccacccttgtctacatcaaaatcatcttcacgaatatcatccacaagatcacgaatgaccccaaccgaatagcttggagtgaacaataattgcatgaaatcgtctgttttttcgaaaagttcagggagatattgatttagcgcgttcgcttgcttggtaaacagaatgacgtacgcagcatccatgtcggacggctcttcggtatcaagggctttctggatgattgcacgctcatccgagctataaccacctaactcatcttcaatattaaaagcttcgcgcaggatatcaggtactttaagttttgttcccgatgacagcactcgaacgccactcgggaggtaatcatttacttccataaatcgaatggcaataattcgattaaaccatgtatacgcaacttcttcgatgaggtctgaaaatgcgtcccgccattcttcctgcttggccattgttttaagccgagaaaccaaatcacggcgacgcttaatatcttggccactgataaatagccccttatcaccataatattcaatctcactggttgatgccgctgatttctcctcaacaccattttcattaataccaagattctccatctttaacctgatacttttaatcagatcacgtctagcttgaatcgcaaatgtcttgattgcctttttatccataccggttcctttccatgactgccaaactttatactagtcaatttgcaaggtcacaaccgtgttatctgacaattgtgcctcaagtgagcgcttaaactgagcagtcagcttatcaatatcagccgaggctgtgattttgtagtcacccttgtgaagaacctcttccagtttgacaatcttctcctgtggtgaaacgaccgtgggacccacaggcttatctggatccttatgcttatcgtcagttttgctttcacctgagtggtcacccgctggtattaattgcgcctttgcatggttaattcggtccgtcagttgatctaattgcgcactagcttgagctggttttgctacaacctcatttaaggttgtggcatccgtggctgcctcagaaatagctttaattctattttcaaaatcatgagctagtttatctttcacgttctgatcaggtatcgctgattcttcaatacgtgtcaagccacgttcacgaaaatcatcaatgtccgctaaataaccagctgccgtcttatcaaaagccgcactaaataattcatcaaactgcttatttaattcgctgattttaacggctgtatcgccctgaagtttttgcaagtgaagcaactttgccatcttgtcaactgtatcctgtagctgattgtcacttaagaaatcacttgactccccgtaaacgcgcaacgcatttaaacccttgtcccagatatcttgcattgactgcgagtaataaaagtcacgaatgccatcatcaagaaaatcatcgttccagtccagtaagtcgtctttgtgtttactgatataatcataaaacgcaccagaatcagacatttcagtcaatggacgtagtaactgaagtcctttttgtaacaacacgtgtcctgggtagtcttgagttttatcttcaaagcctttcagagtttgatacttagtcacgattagttttcttagttctgcggccctctgttcatcgttatcagcctcaaatgatttctttccaaacacttcagaagcaactgtctgcatcgctttgatctttgaaggcgcaacttcttctttaatctgaaaggccaaattacgaattgcttgcttcttagtaaagaaacctgcaatttcacgcggtgtccgttcaccacttagcggatctattactgtaccattgtaaaacatcttaagtttgccaatagcgaccaattttgcgacgagccattgaatatcttcatccgtgtagccatatggaatatcattaaacttcgacaagatgctttccatggtgatatgcgtattattctgtgactcgcgccgcatataatccagaacagcatcaaccgcagcttgattgtcttgctcgtcaagcgccaggctggagatactttcgaaaagttcgcgaatatccttctcagatttggcaacagtgatgtactgcaaactgcgatacgtattgtcaactaagagcttcattgcctgttctaatcgactatcgaaccctgcttcgccattaatcaattggccgttttcataaatagctgcattatcaagcgatgcgatcaactgttcatgagcgtgctggaactcttcattttgctgagattggcgagccaacaccattccctggtaacgtgaatcgcttgatgcactgctattaacaacaaacttctgaattcgtaatgcatttcgaatttcatcgacaaagtttgacgaacgtggtaaagcaatcaagacatcatgattccacgcaccagtcgaaacttgtaaataatcgttgtcactctgaaattcatcattcactggcgtaatgatgtgcactgaaagcttgtttcgctgtgcgccaaaaatattgtccgttttccgattaaaagcaaagacatagcgaccattcagtttgggataagttaaactcgttgcaatacctggcttggcattgaacaagtaatccccaatttccttggcaacctcattgtcaatcacttcttgtttcgaaatttcgcgtgtaatatcttgttcagcatcagtcaaaaagtcataacccttgactgttttttcaacgtaaccttgtccgactagaacctcaagtgcatcgctaacttttttcttaagtgcaattcgatctgcatcgaccgaactaatcatcagggtgatcaaattgttcaatgatgcgttaaagtcagtaacatacttgaccatgaacaatactttaagcagctgcagtgcaaacggattcttctcgtcgttcggattaacagcaggattgtcgtgggcacgcactagtacgatgtgatgggtatgatccaagaattgttccaaaccatcgaaaaagcgactaaatggtgcaagcgtctctgtgtccgcatccatcatagcttcagctgactcttggaagagggaaagcattgatcgctcgccttcagacaaatgtttaccatccgaaccgttttcacgaatcgcagtcagcacctgttgtaagagattaaactgatatggaataaacggatagttttgtgcaaaatcttttggcgacttatattttggccgctctacaccatcatcgaaatcaattgaattattaatagctgcagcgtttgcagaatactgatcttcaagcatctgctcggcaacatcagtcttttccaataaccgcttacgaataacttcatcaacattagccgagctcatcgacaaacgtgttttgaagcgaccttgaattttcgaaaagtcttgtccagatgcaatatccgtcactttgtcaattgcctgctgagaagtcacgactacccatgacttgccgcgtgtcatcgttcccagttgttcgacaatcgtctgcaaattaagcatccgctgtacactgtcacctatgaactggccaacctcatcggccaagaaaatgacccggcgtccagttttgtcgatataccgtttcaccaaagcagcaaaatcatcaatactgatctgatattcggtgctcagcgtttcaatgaaaccctgagcatttgcctcgtcagagaatccggatttcaccattgcttccttgatcgtacctttattcaggtaataggcgtcacgcaactctatccaagactgatgattggcattgatcgctttaatttgctccttaaaagcatccatctttccagcttcagtcaaacgccgctcaaggtcagcaatccaaaaatcggcgtcagtaaatccttgcatttcgttgaagacccgcatgaagactttcaaaatgctttgtttatctgacccaactgtgtctttcgccttagcatcgatattgaacagaatgacatcattgtttgccgccgcagcagcatgcatctcattaagaatcatctggtcgtctattttgtcgtcaaaataatcaacggctggttttccatcaacaattttgtttgccaaaatatatgacacgatttttaaaaaatgcgatttcccggatccaaagaagcctgaaatccagacacccatatcgtcagtcggagtctgtaaactattatcaaaagcactaaagaacgctgcaaaatggtcacgcaactcacgcgtaacaacatactcgtctaattcctgtttaacgtttgcttcgtcatcttgatcaactttaataaccccttgaatgttgcggtcaattgatcgtttaaaaagatccttaattttcattccccatgtcctcctattcgatccgaaatgcacggtagtagtttttgtcatcaagcttgccaaaagcacgtaagctcaaactgttgtagctccctgggtaaaacatgacaacaggcgttttatcaataacctgattcatggtgttcaagactcgatgagcacgaatcaatggaaacacctgcccgatcccggtaatgaagatgatgtttcgctcctcagggtgttcgagatgatccaagatatagcttacgatcagattacgctcgtctcccatttttagcacgttattgatctgacgaatgaccatatcgataccatcgtctttttcaatctcaataaattgctgcaagtatcccatctggtcaattaaatcaataacaacgtcaaaaaggttgaacatttggacatttgcgccaattgaagcagttgtcgaatcatgagcaatatcttctacctcatttcgaacatacagctcatcttcggggtcgtagtcaaagatataaaaaccaacctcatttgataacccgcgattctcttgaaatgcaggatcgcgaatttttttgcgaaaccggtcaaatcggtcacttaattgcgtcataactttctccctgtcagtgcctgaatgtaattagccttgccactttgtttcaacaatgctattagggaaggatccaataatgcacgtttcagagccatccctcccttaacatcctctgctaagccactgtacgttaagatctcgtgaaatttcgtttgaattttcttcaacgtttcatccgtccacttggctgtttctggatgctgtagtggtaagtcttgcaaataagcgctaatttcatatggctccagcctcatatcaccttttaaaaactctttttgaacgaccgttagaacaaaatcttctaccaatggcctttcaagcatgagtgcaataagattcaccgacttttggttactgagagataactgatcaaagatgtcaacgaatccgactggcaacgtactgattcgtaatttcatctcccgcgccagatcttgtgcacggttgcgtgacgacatttgaaaactgttctcctcaacaatagctttcgtgatatcgtcccaatccttaccctcatttagcagtgagatcaccgcagaaaattcagtaaaccagacgcttctggaaataaatcctgctgaaagtttcttcaagttgatctcctttctagaccatttttaagtcacactagactaactacatcatattgtatcaggatagtgccacaagcggcacacctttgctgcagaaataatgcacatgcttgcaatataaaaaggcgagcttgatatgcacggctttctaaagatcacatggtgctaagcattatcaaaagcctcagaaacagcaataataaaacttatccgatggctggcaggaacctaagtatcacctcaactctcaaatgtgctacagtaagtttctgaacaaaacatatcaaacaagttggagcgtgtagaagaaattgactaaagaagcacatcaagtcgtcattccggatgccattatggaggatcttgatattaaagatggcgagcaggttgaggtgacgttgaaggataaagaagcagtgattcggccgaaacggacggatacggggacgcagacgatttcgttgcggtttttcctgattccaacggttttggcggggctgttttttctggcttactttatttattttcagattttgcaggtgccgatgacggggaagaactcgattgcgcagatggtgattgtgctgggtgagttgagtggcatggggacgtttgcggtgacgtatgttcagaatcatcggcggattcatgggcgtgatcatcggcgccggtattggcggatttttccgacgttgttgctggcgtttgcgattattctagcgtttgtggcgtcggtgttcttttgggcgattggctacatgtttgaaggtgtcagttttgatatttacacggcgacagggttgtttttgctgtttatcagtattgtgaactacctgatgatttattcggcgctgtcgatttcaacgtctttcattacgactttgtttttgtcgacattcgttggtggcgttgtcggagcgattgtgacgaacagttcgcggcagtggtggcagcataatgtcagttttttgggaacgagcaaggcgttgaatgcgtggcagtttaacttaacgattgcggtgtcggcattgctgtggattgcgctggtggactatttgttcgtgccgttgatggcgcatcggaaaacggattggcggctgattacgatgcggattatgttaaccgtggcggccgtagcgttactgggcgttgggctgtttccgaataaccgcggcatctggcatgtccttcacactcaaagcgcgtggtttctgaattatttcctcattggaatgatcatcgccgtgcgctggctgctgccgggggtctcacgcgaatttctcagcaccagttacatcatcggcggcatcattatttttgccgcgattctgttccaatttgtccactacctttcgctgacggcatttgagatgatcgcctttgccctcgccatgtcgtggatcatgttgctgctgcagaacattcatcgcttgtatcaaaaagacgaatccaccttcgttgtgacggtgaccgcgaagaaggaaaaggcagaataatcagcgactgaatcgaaaagtggcgtactcacaacgaggcgtcacttttcttttgcctaaaaacttgtccgtggcgtgttgcatggttcctacactgtggctgcaacacgcacagtttcgaaccttaagccttcgatcgccagccctttcactagcctgactccacggcaatcaataccaaaggatagcgttcttggctgccgtgcacgcgcccacagcctgtctactttcgaacacttgcgcccttcaatacccttttcccacacgcaaacaggcaatgccactggctgatcaccagcaacattgcctgtttcaattgaacaatctttacttttgccacccgcacgaactactcgatgattttcgactcgcgcgtcttctcattcatccgctcaatccacgggtgaattggcgctttcaagaacagtcctagcaggaagaagacggtgccgaatgccagaagtgccgcgacatcaatccagagatttggccagtagatgccgccgactgtttcgcgtaggagattgacggcgtaggtaaatggcagccatgggttgatcatctggaagaacttaccggataagacgacagggaagttcccgcctgcaccggagatggaaaggactaagatgatgatcccgatgcctttgccgatgttgccgaatagcgcgattaaggcgtagagaatggagacgaagaccagactgagcatcatggcaaatagcaggtaaagcggcttgttgacgacgtacgtgccgattaagaacaggttgccgagtgcagcgatgaggccttgcagcatccctaggccggcaaatgtcagccagcgtgcggtgtacatctgcttaaccatggcgtcgctgagcgttggcggcagtcgatactcggtaatcaggatcgcacccagcagcagtgccccgacccagatacagagtgccaggtaaaatggcgcactttgcgaaccgtatgtcggaatgtgatagaagctttgctgtttgagttcaaccggtttagctaagaagccggcttctttggtggcgtcgcggcgtaacagtttgattaactgggataaatcgacggacttttcgccttttttaatggccgcggcgcctttttgaatcgcttcttttagcgtcggccagtcgtttttcacgaatttctgggcgtcatccaaaccgctttggagttgcggcattttttcgtttgccaaggccaaggtgttggtgaggtcggattcgacgccagggagatcttgattgatgaagtcggtggcttttgtcagcttggttttgaggctagggaaatcattttggtataaatccgcgacggttgtgatgccgctggtgatgagatccatgtgaccgttaagcagcgcgttggcgtcggtgagttcctgcttgagtgccggcagctgctttttcgctttgaccaaaaagttgtgcgcctgcgtcagtagatccttcgtgccactgagcagtgacggcatggatggcaggatctgctggttaatcgtatccagcgtggtgttggcatcgttgagagccgctttgaaagcattcaaaatctgcttgacgctggtgccgagatcaagggctttgagtgtattggccgcgtcggcgaactgattggcagtgttggttaaaacgccgagccgccgctgcaattcactcgtacttaggttaggtacatccttagccaaagcttcggcatcgcgttgaaccgcagtggctgtcgcggcaacttctttgagcttggcaatggccccgtcaagcccatgatcatccttgccggttaactgattaagagtggtctgcacccgggttaacgtgtctgctaagctagtggcgttggcggcaaccttgccttgacgattggccagtgccgtcagcctttgcgccatcgcttgcttcaatgccgcggtgtccttgctgctgtctaattgttgtaattgttgctgcaacgtggtcaagtccgcgctcaagctggtgttggcagccgcaatcaatgtcagcccggcgtcggttgcattttggaccacacccaaggccgtattgattttgggaatcacgtcatctttggtcgttgccaccgctgcttgggcatttttgccaaaatcggttaaagccggcagcgtgccatcgacttggttaaccaccgtgatgccttgatccgtcacctgaactgctttggtgacaccggattcgagctggtcaaaattggtcaccaccgtattcagctgctggcctgcctggcgaacttcgggtagcttgcctttaacattcgtggcgagctcaccggcatcttggaccatgggcagatagccatttgcccccgtgagcttttgagccatttgattgatttctggcagatatcccgccatttcgttagcggtttgcagtttggcgcgaatcgcgggcattttagcctgtagctggtcgacttccgccagatacttttcgatcgttggcagctgatcgttggtattggtaaccaagctggtgaagcggcgaatcatcggcaggttttgatctagcttgatgcccgctttattgaaggctttcaccaatgtcttggctgccgttgagataaattcgtccgaaattttgttttgcagcgtggtcgcgccggtgctggtgattttaggcgccaccgcgttgattttttcgttgacgtaataatcgagtttcggtttgtgaattttgccatcaacgaagctcagcaagtcttttgaaaaatgctttggtaccaccaccccggcgtagtacttaccgcttctaacgcctttttggacggcttgtttggagtcgacaaagcgccagccgagttgtttattatcttttagttgatccatcagctcatcgccgactgccactttctggttgcgaaaagtggcgggttgatctgccgagtacacggctacttttaaatcctgcgtgttgctgtaaggatcccacagcgcccagacgttgaaccagcagtaaaggctgggaatgacgaccagcgctgcgatgagtaagaaggctaaaggacttttgaaaattcgtttccagtccagcgccactaatttgccaatgttacgcataacgtcctccgagtcctagattgagatattttctgattatatcacaggtgtttggtcacgcaattggacaaaaagcagaaagtgtcgggatgaagctttggctttgtacgtccttcatcctacacgctttcacgttttttcggtactcctaaactaacgggataaaaaaagccttaatcccatccccagtcacaataactagggcgataggattaaggcttatttcagcatcttttacaaggacgctggtgaaaccgattcgactttgacatcttcacgctgcactgccaacagatcagcgccggcttcaaccgtggtgtcggcaactggttcgatccgggcataggctttgctattggtgatcagcaccatcgttgtcggatcaaggccggccttttcaatggctgcgcgatccatggtccccagcaagtcgcctttgttgacgtgttgcccggctttgacggccactgtgaacggcgcaccgtgtaaattaacggtatcaatccctaagtgcaccagaatttccatgccgtcatcgctgttcaacccgtaagcatgacccgtgtcggcaacaaccgataaggtgccggattgtggcgcgtagattttgttgacgccggcattttctggttttatcgctaagccgtcgcccatcatgccggaagcaaataccggatcgcttaccttattcaaagcaagcgtttcgccgctgaccggtgcatagaccttgttgtcactcacggttgacgaaatcactgcattcgccgtttcgacatcacgatcgggcgccaagacttctttaggaatggcaaaagcgttggtggcaacaaacgcaacgacaatcgtccccagtgaaacgatggtgtaccacagcaaggcgtggccgttgtaaatatacatcaggtatgacggaaccacggcgagtccatatgagttggcggaaacattgagaatgctcaagaccgccgcgccaagtccggaagttaacacggtgacaattaatggccgaaaattataacgaatcaaaaccccgaataaagtcggctctgaaaccccgaagagttgtgaggtgaatgcccccattgaagttgccttggctttaccggaacgcgcgcggaggaaaatcgccaacgccacgcctaagtttgcaaagccgtacatggcttctaacgtaatcaacggattcaagccggtggacgccagcagcgaagtttcgatggcaatcatggtttgatggatcccaatgagcaccatcagcggataagctgccccgatcaggaagccgccaatgccaaatggtaagtgaatcaccgcctgaacaccaaccagcatcccgttttcaatcgcatggacaagcgggccgacgcctaaaatcataatggcaaacgtgaccagcatcgttagaaatggcgtcaggatttgctccaaaacattcggcatgtgacggcggaagaacagctccagtttcgcaccgatgaacccagcgaccaaagcggttaacactgacccctgactgccaaccactggcaaccagccgaacagcatgatcgccttggcactgccgtctgcaactgagtaggcattaggcaaaatcggcgaaactaacataagaccaatcacaatcccgataatcggcgtccctttaaagtagcgaaatgaaagtagcgaaatgtcgaccacacaatcaacgccggcaaaaaggcaaacacggtgtcggtcagcactgaaacgaccgaggtgagactggcgggaatgtcactaggcacggcgccgaaaagctttaatacctgagcgttggtcgccgcactttttaatcctaagaacagtcctgtcgccgcaatgacggggatgatcggaatgaaaataccggataacatggccattaagcgttgcacccaagtcttatgttcatcgcttgccgctgcggtggtgtccgcatcgtccttgccataaatcgcattcacggtccccagcttggcaatcgccgcgtacacatcgttgacaacgccggtaccaataatcacctgatactgaccggatccatagaaaacacctttgacttccggcagctgctccaacgccttatcgtcaatagccttgcgatccttcacaacaaaacgcagccgggtttggcaatgagtcacggaatcaacattattgacgccaaccaacttcaaaattgcttttgcttcttgttcataattttttgccatcttaattcacctcaatgagaatcgcttggtagggtttcaacgttggtgctgcagccggataattgttcagccagattcggccagccggtaagtcgatggtcgccggtgcagcgctgagattgacatagatccgcaaatgtttcccgcgggcatatgcgatgacgtgttcgtctgccaccgtaagcggcgaaaaatcaccatcaatcagatccgaccgcaacggcgaatcattacgcaactggcacagcttttggtaaaagtgccagaccgaatcgggatcgatctgttcatcctgccagttgacgccgggtgcttgttgggccaccggtagccacggctggtgatcgctgaacccgccgtttgcctcgtcgttccagagatacggtgtgcgggcattatcacgcgagcggcgattgacacatgccagtgcatccgcttttgaataaccttccgctaacgcccgccgataattatcatgcgccgacaaatcgttaaattgatcaatgctgctgcgaaccgcattcaccattcccaactcctgaccttgatagataaacgggcacccgcgcaagcagaaatacaataatgccaatgctttggcaccggtggcattgcggtacgccggttcgcgaatgtatttactcaaactccgcggctgatcatgattttcaagaaaattagctccccagccgacgcgttgaatggccagctgactttttgcaatcgcatcgcccagcattttcggcgtccactgcgtctgcttgaaccactccgaaccggaagctacatcaatatcggcataatggaaatcaaagatcatggaaaagtagccgtttgggccgatgaaatcgcctagttcatcataggcgaccccggaagcctcaccgattgtcacggcattggcaggcttaaaggtagcagcgttcagttctttaaggaagcgcgctaggccaggccgattctctgccttccgcttcaccttgcccaggccatcgttgccatctggcgtaatcgctgcaaaatcctgatcctttttgatgaaagtgatcgcatcaacccggaagcccgccaagccttttgccagccaccagttaatcatctggtaaatcgcctgccgcagcttgggattctcccagttcaaatccggctgctgcggggaaaagacgtgcaggtaatacatgtcggcttcaccgggaaccgccgtccacgccgagccagcgccgaaattagagcgccagttattcggcggctgtccgtcatgacctttgcggaaaatataatactggcgatagggtgaagtcggatctttcaacgcggcttgaaaccacggatgctgatccgaagtgtgattcaccaccagatccatcaccactttaatccctagttctttagcagcggccatcaacgcgtcaaaatcagccatggtgccaaagcgcgggtcaattgcctgatagtcggagatgtcatagccattatccaccatcgggcttcgataaaccggtgacaaccaaattgccgtcactcctagggccttgagcttcggcaactcactggtaatccctggcaagtcgccaatgccgtcattgttgctatctttaaaggacgccggataaatttgatagaaaatttcttgttgccaccatgtgcggctggtttcgttaagcatgcgtaactccttcttcataatgtggtatcgattccatatttattaaaaataaaattcaggcgctttgcctgatttttaacgtcaaagttaacggttctggagccacagccggttcaccgcggccaagtccggctaatagtaagtccgttgccacctgcgccatttcggcaacaggctgatggacggtcgtcagcggcacgcgggcaaacggtgcaaacggctggtcgtcataacccatcaccgcaatgtcatccggaacggcaatgttagcagcgactaaactgtccacaacgccaactgccacttcatctgagttcgtaaaaatagcatccggacgctttgccggtgccagcgcggcgatttggcgtccgagcgtttggccttctgttgcggtatgcacctgctcaaacagccaggcaggttcgactggcaacccgcgcgcttgcataaaatcaaagaaagcttgggttcgactttgaccgtggcgggcacttttaatcgcaccaccggtcatataagcaaaacgacgatgaccttgtgcaaataggtaatccaatgcatcgcgggttgcctgatagtgcggtaacaccaaagacttagcattgggaatctgcacatccgcattgaccacgacaactcgcccaggaaatgctttagccacggtcgccacccgcgctggtacttcaactgacgctaagataacaccatcaagttcgcgacttttcagctggttcaaaaaccgctcctcggcatccggattatcgtaagtttgcgaaatcatgacttggtaaccgtgggcgtgcagtgttcgctcaatggcatcaaacaagccggcaaaaaacgggttcgtgactcgcgagaccaaaacgccaatatttccggttgcctgggcgcgcaaggaggtagcggctgcgctaggcgtataacccagcgtcttgatcgcagcttcgatccgcgccttcttatcagcggaaatatacggatgatgattcaagtaccgcgataccgttgtcaccccaacgccggctgctgcagcaatttcgctaatcgttgccatgaatggcgcacctcctgtttatggaatcgatttcatactgtgagtatacagcgctttcaaaaattgtcaaggcacaactgaaaaaattcgattacttctgaaaatgaaatgcctcggtgcacagatgactgcagttgattggcaaaaaagcatcagccaatgtctgcacaaatgacatttggctgatgcttttttatttattggcgcaaataagttgtttaaatggtggcgacatggttgatatcagatgtgctttctactgacatcgcttcattcagtttcaaaagcggcctatagcccgccattatccttccgcagattccacgcctgcacgttgctaaccgcagcaggtggattcacacgtgcggcagtggggcaagtgtccccaaagaagcgcccggaaaccacccgataaccatcgtcaatgaacaactcgaaaacggagacgtccacaaacaaccgaatcgtgaccgttttgcctgctgggaaaccaaattgccgcaggctgccgccattattacggttctcgcgctgaaccatcccttggccactatctgagtcaagattgatcaacagttgatcgtgatcaccatctggaacatggacggtggctttttggccggcagctaacgtcatactcagttcgaacgcaccgctcaacgccgtgactgaacattgatccgtattttggctgacaactggtaaggcatcagtagcagtttcccgaagctgttcaatgttgggatgtggctttaggcaaacatgaccatcgcgtaaatccagctggcgcacgtaactcaagacgccttcccacccgtctgcatccgttgggtaattcgtgtcgggtaagcctagccaggaaattgctaaagtgccatctttttcggtattggcaagccgggttgcgtaaaagtcaaaccctttatcgatattttgcaggcgctgatgggtcagtgtgccagtctccggatcaaagctgtcggccacaagtgcaatattaggataaacattttcgtattcgaaaaagtcttgatccaagccttgtggacaatatactaagacgactttgccattaatgaaagcaatgttcgggcattccaccatgtaaccgcaaaattcgtccgggatacttaacggggccacaaagcgccaggtcttatccggttgcttttcatagagtaggatggcgccggtgtgatcggcccgctgaccaccaattaagacataggttttatcttgataattaaatagaaatggatcccggaactcttgggtgtagccagcaggcggattagcgatcaatggcttcggatctttatataaacggctatctgcgcccagaaccgcccctaattgcgtggactgtcgatgccactgctcatcccgcacattaccggtgtacatgattcgcagcgtaccatgcgtcactaatgccgaaccggtgtaagcaccttgcgcatcgagttcgttatccggcaataaatcacccgggactcgccgccagttgaataagtctttggatacgacatgtgcccacgacttcaaaccatgaaccggaccaaatggaaactgctggtaatatagatgccacttgccattaaagaaattcagactgcagggatcattgatcaagcccgtatccggttgaatatgcgtcttagttcgccattgactcgcagcaacctcagctttcaagcttgccacatactctggtgtccacgtcgaatacggctgataccgcttagccatattctcaattgagtccgtcatgtacttaccaccttgtgtttggaataatacccttatcttatctgagttcgcggcattgtcaatggaagcgcaaacaatgcggtgatccgggctgcttaatcattgattacgcacgaatgacccattatgccacgggtacgactaaaaatcaccaagaaccgcacccctttttaaattcgcccggttaaaaagcgagccgcccaactttattcagcttaaaattcaacacaaaacccgcggccatcagctgcgggtctcagttttaccaatcggagggtaccaattggcaatcattattttggaggagtagaaatgaaaaagttgggttggggtttaggaatgagtgggtggctcatttctatgttgttaatactaccgacgaactttgaacattctgtgacggcaaatcgctctttgtgttaacaagattttctgccgtgtttcacgacattgcgttccaccgccaaagtcatttttccggtaaaaagtcgcgccgataatcgtggacatattgcgaaaacgtgattgccggtcgcccaagcacttttggcaacgttgtggtcacttctttggcattccccatttgcgtgatcagatacagcatgaccatcacattcacataattcttcggcaagccgcgcgcaatcatggtgtggcgaaaacgcaatagacttggccgactatacgttatcgggacgcctaacactgccgtcatggttttagcgacctcggcatatgttagcgcctgatcgccggtaatcgccagcttttggccaatatattgcggatcacacaggacagttgctgccacggcaccgatatcgcgcgtatcaatgaaactcgtccgagcgcgtccagccggtacaaatagatcatggtgggccacaatgtcatggcgatgcgtggtattgagattttgcatgaaaaagcttggccgaataaatgtgtacggcaacccaagtgcttcaatgcgtttttcaatcttatgatgcggggtcattggattgtgttcaacgcccagtaacgagacgaaaaccgcctgcttaatcccatggcgcaccaaggcatcaagaaacggatacatgtccgttttgggttttgctaattgcggcgggcgcacgaagaagaccttgtcaatggccgccaatgccgggtcaaaagttgcggcgtcaagaaaatcaaatttgcgtaattgaaccggcaagtcccgtaaagttgcacgcgcatgagccggcgaatgtacagcagcaaaaagttgcacgtctgcacgtttggttaaagcttgaatcagcggcagtccaatattgccggtcgctccgatcactaatatattcgtcaagttgaatactcctccataaaagaaaagcacccctgaaggtaccttttcaaagctgtcgtatccataaaccgttaactaaatttccggcactattcgtacatatagtcacgggtggccggcaagtccttaccagacggacccttgctaatcagatactgcatgacatcaatgttaccggcctcaaaactcgcagcggcggcttgcaggtaaacatcccacatgcgcgtaaattcataaccgaacttttgctgaatcggattacggtgattattgaaattcgtatcccaaatttcaagcgtccgctgataatggcggcgtaatggctccaagtcgtccaactgcataccggaatcaataatatgggtcagattttccgccatcccaggcacatagccatccggaaaaatgtacttattaatccaggcattcacagccccgccttgctgccgtgtaatcccatgaatcaacgccacaccatcatcttttagcagcttagcaacatctttaaagtactcttctagattttccttaccgacatgttcaaacataccgacagaggtaatgtagtcaaacggttcgcgatctaattcgcggtaatccatatatagaatttccgccacgtcattcaggtgttccgcttcaatccggtcagaaaccagcttaaactgttccttacttaaggtgatgccaaccacatgcagatggtaagtcttggccgcccgtaacatgagcgtcccccacccgcagccgatatccaataacgtccgacccggctgcggattcagtttgcgtaaaatgtgatcgattttatttaattgtgctgtttccagatcgtcatcccagttctcaaaataagcacaggaatacgtcagcgttggatccagccatagcttgtaaaagtcattacccaagtcatagtgtgaatgaatatcctgcttggacttgcgctcggtgtggctttgcttaggcaacacgcgcatgagtttgttgttacgcataaaactgtctgcactggcataggccgccgcaattaattgctgcaacggccgcttaccaccaagcacctcaatgtcaccacgcatgtaggcctcacctaatgcaagcgaagcattctttagcagcaaacgcactgggatcgcttttttcattttaatcgtgatcgtcggctcgcctgttccatatgtttcttccgtgtggtcccaatactcaacacggaccggaatattgaaagagtgactgaacatggtatgataaaactttttttcgagcatgatgacctccgttttgaaaagttacaaccgtaattataaagctttttgaccaaagaaaaaacaccgccaatgaaatggacggtgtgttgccgctttcattaaaattttcggaagcgggcttgacgctgggtaaccagtgtctgcggatccaatgccataagggtcgccaattttggcttaacctcggctttgagtgcgctggggaagtcggtaccggtatccgtaattatccgatcacagacttttttagccaataaatcccgcggggtcagctgcatcacttcagctgcttctttggcgcggctggaatctttccacaaaatcgccgcaaagccttctggtgacaagatgctgtacatgcttttatctgtcatccagacttcatcaccaaacgccagcgccagcgccccgcctgatccgccttcgccaaccaatattgccagaatcggtgtcggtaaatcggcgcacgtgacgagcaagtctgcaatcgctgccccttgcccatttgcctctgcttctttacctggataagcaccgggtgtattaatcagcgtgacaatcggacgatgaaacttcgccgcctgtttcataagccgcaacgccttgcgataaccccaaggctccggactgccaaaatgggtctgcaaccgttctgtcaagtcattgcctttatcggtcgcaatcacagttacagcttggtcatccaaccaaccgatgccgccaatgacagccggatcatcatgactggaccgatcaccatgtaattcatgaaaattggcgactaagccgttgatgagttcgcgggtggtatagggacgtggtgcgcgcgccgcttgaacggtggcgtaggcggatgtttcttttttgggcatgccagggtacctccttgcttcgtgttggtgctggtggggatgttttccgatgctgaaatgcgttcacagtcgcagaaatctgcgtgtaaggacctcggccaaagaccggctggatcggaaatagccacttttgttgcggttgggggatgttctccgatgctgaaacgcgttcgcagtcgcagaaatctgcgtgtaaggacctctagcctaaatggccaaagaccggctggatcgggaaagtcacttttgtttcggttggggacattctccaatgctgaaacgcgttcacaggcccagaaacctgcacgtaaggaccctgagcctaaatggccaaagaccggccatttaggctcagggccacttacgctccggtttctaagcgggcctgttcacgctctgtgcatttgtagcatatccccaatgtaactaacctgctcacttcttggaacaatggcgtcgatgaagccgctttggaggacggtttcggcgcgttggaagttttgcgggagtttttggttgatggtttgttcgatgacgcggcggccggcgaatccgatgaggctgtggggttcagctagtgtaatgtcgccttgcatggcaaagctggcagtgacgccgcccatggttggatcggtgagcacgctgatgaacaataagccggcattgctgtgattcttcacagccgcactgacttttgccatttgcatcagcgaatgaatgccttcttgcatccgcgcaccgccacttgcacagtatagaacgactggcaagtttgcttcagtggctttttcaaacaaacgtgtgatccgttcaccagtcacggttccgagtgaacccatcataaacttaggatccataataccgagaccgcatacctgtccgccgattttcgcctgaccggtccaaacgctgtcttctaaaccagacgcctgacgtcccgcggctagtttcttctcgtaacccggaaaatccagcgggtcggtcgtggttaaatccgcatcccattccgttgcatctgttgctaccagggctaaccgttttttggccgtgatgcggaatccataatggcaatgcggacaaacctgagcatcgccgagactttcacgataactgccttgcttgcagtatggacattgaatccataagttttcaggcaaagccgcctcacgagcaagtgcttcttgggttagttgtggttggaacatgcagcatccttcctttcatcctgccattgtggcaaaaagtcacggttgagataagccgtatcagcttctccagccaataccttgggtgcctggaaaagtgccagtgcaaagtcgcggttggttttaaccccttgaacgtctaattccgtcagggctcggtgcattttagccaaggccgcttgtcgggtttgaccatgaacgataatcttggcaatcatcgcatcatagtacgggctgattttatcgcctggcgccacgccggtatcgacgcgcaaacccagtccgccagtcggaaagcgtaattgttccagcgtcccgacatcgggcataaactgatgatccggatcttcggcattgagtcggcattcaatggcaacgcctgaaggttccggcgtggtcaactccacgtcttcgcctgccgcaatgcgcaattgtgcctgaaccaaatccacgccggtcaccatttccgtgatcggatgttcaacctgaatccgcgtattcatctccatgaaataaaaatgatgttgctgatccattaagaattcgatcgttccggcattaaggtaatcaacgccgtcagcaattgtttcggctaaatgcaacagcttagcccgttccggtgacgttaacaccgggcagggactttcttcgatcattttctgactgtgacgttgcaggctgcaatcacgctccggaaaaacgctcacgtgcccttgctgatcgcgcaatacctgaacctcaacgtgtttagccgggacaatcaccttttccaagtacatggtgggatcaccgaatgcggcttgggcttctgcctgcgccccggcaaattcggctgtcaggtcatcggcactcgccaatttacgaatacctttaccgccaccgccagcactggctttaagcatcagcggatagccaatcgcctgtgcagccgccaatgctgtatcgacatcctgaagcggccggctgccagggatcaccggcacaccaatatcaatcatcgtttgacgggcaacggctttatcacccatttgctcaatggcagtcggcttgggcccgatgaaggctaacccggcatcagtcaccaacttggcaaattcggcattttcggataagaaaccaaaacccgggtgcaccgcctccgcaccgcttaaaatggcggcactcacgacattgcgcatattcagataagaatcagttgcccgcggaccaccgatacaaatcgcttcatccgccagcaagacatgtaggctgtggcgatcggcgttcgaaaacaccgccaccgaggtgatgcccatttcccgcaacgtttgaatgatgcggaccgcaatctcgccacggttggcaacgagtacttttttgaacacagttccacttccttacacgagtctgaatcgggtcgatttaaccaattgcaaagacaagttcggcactgcaagccatatcttcgccgacgtaaaccttgccttttcctaagccggcattgtcgatcaatttctctaaagtgacctcgatgcgcaaaacatcgccggggcgtaccatgtgacggaacttagctttcttaatgccgccgagataagctgttttacctttaaagtctggcatcgaaagcaaagcaattgcccctgcttgcgccattgcttcaatctgcaagacgcccgggaaaatcgggttaccgggaaaatgcccctgaaaaatctgttcgttgatagaaacgttcttttgtgcaaccacagattcgccgggtttgagatccagtacccggtcaatcatcaacatgggatatcgatgtggcaaaatcgcctgaatttcttgtgcttcaagtgtctttttggtttcgagcatgaatgctatcctcctaaaacgtgtttatggagccggaatgcgactcggtttacgctttgtcttcttgtacgatgagcaacggctggtcgtattcaactaagctttcgttatcgactttaaccgctttaaccgtgccgctaacggtacttttaatctcattcatcattttcatagattcgatgatgcagacaacgtcaccttttttaacgtgatcgccgacttgaaagtacggatcagcgcctggtttaggagccagataaacgattccgaccagtggcgctttgaccgctgtgccttcatccgcttgcggcttgtccggtaccggcgtgacgggtgtcgctgccgtattttccggagccggggtcacaggtgcaggcgcggcagcagggcttgctttgaccaaatgtagcgagtcgttaccaagcgtcagttccagctcgtgcagcgaactttgctccaactgtttgatcaaaacttcgatcattttggtgtccatgacactcaccaccttttgaaggccaaaacggcattatgaccgccaaagccaaaggagttgctcaatgcatagtcgaatgatgtatcacgattgtcgcgattaaccagcgtgaccgggcaatcctcgtcttgagccgcatccaccacattcattggcaaccggccgctttgtaaggcacttagcgtcatgatcgcttcgatggcaccagcagcacccagcagatgccctgtcagtgccttggttgagctaaccaacacatcgtcaccgaaaagatcatggatggctttactttccatcgcgtcattggctttggttgctgtcccatgggcattaatgtagccgacttcacttggcttaattccggcttcttcaacggccaattgcatcgcacgtgccgcctgagagccacttggatcgggcgccgtcatatgataggcatcactggtggcaccatagccaaccacttcacctaaaatcttggcgccgcgtttttgtgcatgctctaggctttcgagaatcaatgcaccgccgccttcgcccaaaacgaaaccattccggtcagccgcaaatggcaggctggccttggttggatcggtatttttggacaatgcggaaagcgcagcaaaaccggcaattccgatttcgttaactgaagcttcggcgccgcctgtaatcacaacatcggctttaccggtttgaatccgcatcgctgcttcaccaatcgcattcgtagctgaagcacatgccgttacgacaacatagctggggccatgcgtaccaaagtaatgggaaattgtccctgcgaccatgttactgatggcttccggcacgaacagcggactcacgcgatccgggccttttacatacatcttcgtcacttgttcctgaatggttgtcaaaccaccaatcccggaaccgaaaataacgcccactcgatctgaatcgaccgcatcttcagttagaccggattgttcatatgcttcaatggcactatagagaccatattgggtaaacagatccatccgtttacttaggcgtttgctcatccgttcttcgggtttgaaatctttgacttcaccagcgactgtgattccggttttttcagcatcaaacttggtgattggctggatgccgaccttgccagcgtccattgtcgccacagtttcggcgactgaatggcccagcggattcacagtacccattccggttacgactactcgttgcaatgtcattcctccgttcatgtacttaacctaatccgccggcgacagtcactgtctgaccggttatgtaggcattttcgaccagaaaacgggccgtgtgggcaatttcttcaggttgaccgaaccgcttcaacggaatctccgctagaatctggtcctgactggattggctcaaggcagcggtcatatcggtggcgatcatccctggggcaatggcattaacgcgcacgccacgcatagccccttcacgagctagcgtcttagtcagcccgatgatgcctgctttacttgccgcataattggcttgaccgatattaccggtcaaaccgaccacactggccagattgatgatgacgccagcgcgcgcctttagcattttcttaaaggccggttgggtaacataaaaggtgccatccaagttaacctgaacgaccttggcaaaagaagcgggtttcatgcgcatcgccaacatatcgtcggtaatgccggcattattgaccaacacatccacgctgccaaactggtccaaggcagcggcgaccaattgatcaccggttgtgggatcatccacactgcccagcacggtcacaacaccgtggccatagtcttctaattctttgatcaaagtttccggaaattcatgccgcgcattcaagaccaagttggcccctgcttgcgcaaaatttctggcaatcgcttcaccgatacctcgtgaggcacctgtgatgatcgcggttttatcagttagtttcaatctgccttcactccgttattcaaatctgctacctcattgagacttgctgcatcacgaatcaggtaggttgtcatcttgcggtcaatgcgtttaatcattttactaagtaccggtttcgggcctaattcaacaatcgtatcaacgccttgtgctttcagttgtgcgatcacggcagcaaacttcgtcggttcggctacttgtgccgccaataccggccggatgttgctagctgaaaacggcttaagtgccgtcgtactaatgaccggaatcactggttcaaagacatgagccgctgccagtgccgcttgtaatgacggttgtgcacttgccattaacggactatgaaagcccccggcaacctgcaaaggaatggcgcggacaccttggtctgtcaaccacttttcaaccgttgccaagtcatcatgtgtccctgccaaaaccgtttgcttcgggccattgtaattagccggccaaacatgttctgcctgctgacaagctgttttgatgatggtctcatcgccgctcatcaccgccagcataccgcctggttgttcttgacacgcggcggccatcgctttaccacgggctgcaacgagctcaagtcctgattctaagctcaacccgccacctgcgattaatgcgctatattcgcccagactcaagccggctaaagcagcttccggcggcaactctgctgaggcaacctcatgcatggccacactataagcaactaaggccggctgtaggtaatccggatgggccgcaaaatcaccgttagccaaaaactctggcaagtcaaagtccaaaacggcatcggcacgatcaataatctctttgaatatcaaagtattctggtaaaaatcaatccccattccggggacctcggcaccttggccgttaaacacataagcaaattgcaaaaagtggtacctccttgcctgcgtttgggttacgcttgcacgtcaacctgactagtgagcaaagccgccattttcgagccggcgacaatttcttttgcctgctgcatgacttcttcaacaatgtccttgctgctttcttcgcgtttcactaatccggcaatttcgcctgccataaaggatccatggtcgcgatcgccttctagaacggctttacgcaaactaccattacctaattcttccaccgctgtaaaatcagtggtgccagaaagcgcaatttctttttccagtttgagataattgcggctcatcgggttcttcaagacgcgggctgcatgaccgacatacataccggtaacaagggtatcgacgtcttttgctttaatcacagcgtctttgtagttttgatgaatgcggcttgaggttgaggttaaaaagcgggtccccatttggacaccaactgcacctaaactaagcgcagccgcaacgccgcgaccatcgccaataccgccagctgcaacgaccggaatatcaacggcatctaccacttgcggcactagggccatcgtggtgatactgccgatatgaccaccggattccatgccttcagcgatcacaccatcaacgccgtcacgagccatgcgcttagccatcgcaactgacggcacaaccggcatgaccacggtgccgttttgctggagccgttccagatagcggctaggatcgccggcgccggttgttaccaaggcaactttggcatcgacaatcacatcaatcacctgttcgacaaacggcgacagtaacatcacgttgacaccgaatgccttgtcggtcattgattttgctacttcgatctgttccttaacccatgaagcaggtgcatgaccggagccaatgataccaagaccgccagcttcagaaaccgacgcagctaatttgccgtcagcgacccacgccatgccgccttgaaaaagcggatatttaacgcctaaacgttccattaatggactcattggcccactcctctccagtgtcttaagcttcagccttttcagtgatgaacgtaaccaaatctgaaaccgtttcgatgctttcgtcagtatcgatcttaacgtcgaattcgtcttcgatttcattaatgatttcgaaaatgtccaagctatctgcatccagatcattcttgaagttcgtggtcaaggttacttcttcaggcttcttgtccaattggtcagcaataatactttgtaccttaggcaatacttcttcgttagtcatgtttatatgttctcctttgagtgttaagttttgaccgtttcattggtctgtcaattgtaaccgttagttagtaagtcatgataagtgagccaacagacaagccgccgccaaaaccgctaagcactattttctggccgcgttttaactgaccgctttctgccaactgtgccaacagaatcgggacgctggctgcgctggtgttaccatactcatcaatattgatcgggaattttgcttccgcgacttttagctttttattcactgattgaacaatgcgcgcattcgcttgatgaagcaaaaaccagtcaatgtcatctgttgtcaggttagcttgttccaaagcccgattgatcgaacgtggtacttcgctaatggcaaactggtaaaccgcgcgcccattcattttgaaatatggtgacggttgcgcttgttcatcggcaaaggggctttgatttgcttgctccccagccaacaacaccatctcggtatcaccgaaactctttaaatcaactgcttgaaccggggcgccttgatcactaaccaaaacgccgccagcaccatcagcgaacaaaactgctgtgcgccgatcatgccaatcaactaaccgggaaaggacttcactcccgatcaccagtccttgatgaacgttgggactggtcatcagccgatcagcgacatgcagcgcatattcaaaaccggcgcaagcaacattgagattaaacgcaaatgcgtgattcgcatttaaagctgcttgcaggcgattagcctcggccggggtggcatagtccgggctcatggtcgccacgatgatgaaatcgagctgatcggcggtgaccgtcgatttttctagcaattgttgggcgacatcataggctaaatcaaagttacgctggtcagtgaccacatgccgggttttaatccccgtgcgttctctgatccattcatccgatgtgtccataaattctcgtaactgctcgttttcaatgcgcgtggctggcaccgagtaagcactggccagaatctccaagacggggccttctttctaatgacgatattcgtcaataaattcattgagattatcaagcgcgcgttcgattagctcgatttgcggttcggtaaatcccttaacaaaactggcaaccattttttggtgaaaagcaagatgcgcccgatacatgagtcgtcccttgcggctgagtcgcaggttcacaacccgtttatccgactctagatgcaaccgttcaacatagcctttgcgcgccagattgttaatggcgacgcttaaagtgccttgggtcacatgcagcttcttggcaacatcactagagctaggggtcgcatgaataccaatcgcatcaatggtatgcatttctttaatgcctaaatcccggaactgacttttacgtagttcctcttcttccattcgtaaaatatccgaataaacgcgaatgagcttatcgtttatccgcttgacgcttggcttttgggacattggtgtgcctccgtgtacaactgatttgatactcaaagtatcagttgaaaaaaaaagcctgtcaagtggactaagcatttgcttctaccacaaaatgcaattctgcgtggcagacaagctcttcaccgatactggcggtcgttgtgaccacccccatattcgcccgaaccttacccatcttgactgccagtgtcagcacactgccagttggaacgggtttaaggaattctgttttgccgatacttgccagataagcagttttgccggcaaacttcggtgacttcagaatcaaaatcgatgctgcctgcgctagcgtttcaataatcagcgttggcggcatggttaactcaccgggtagatacgcaaccagatgatcttctgccacgctcacgtatttctctgcgacaatcgattcatccggtactaattcggtcacccgatcaatgtaaaagagcgggtaacgatttgggattagcgtttggatggttgaggtatccaaagttgtcatagcctcgcctcctctttaaccgcggcctcagatggtgacagtcgcgaaaatgtctaaaagcagttgtgcgatattttcgcgttgaaccgtcatcactggttgccggtttttgtccaaccagattaattggatgttcaaagcatatgcagaactgttttgattgtcaaacctttttcgtcattattcatttgtgagaatattgatattcctgaatgaatgcggtctcagataatattgttaagggatttaagggttgccataaattgataaaatatgcagaaaatttatttattaaattttatctgcgaacggtcgattgacgagccacccacaactaatttggtgaatgacagttggttgatcatgacggcaaatcggtttcaacttgaagctgataatatctggtgatgtgttgttggcacgatggtagtcgtttggaaaacactgcctgatatgtggatttctaactgcgccgtttatgctcactttctataacgcgctccccagcgcagaagtctgcgtgtaaggaccttaagcgcaatggccaaaaaccgggccatcgcgcttaaggccgcttacactccgacttctaaccgcgctggctcgcgctcacataaaaacggccatccgccttgggataaccgctttttcgatttaagttcgtttaagcctttttactgctaatgacggctgacggcagcgcgtagttcactgtcttttagtttcagccgcacaatggttccgactttttccgggtcatcaatccatggttcatggcccgcaccgttgatcgttgttaattcaccatgttggacaacagcggcgatctcctgacctaattcaggattggcaaatgggtcgttggttccccagattaaactcatgggtaccgttagctgccgtaagtaccgttccggcaagacgttggattcttttgaccgatacatgctgcgtaataacgacaaggtggttaattgataatgcggtaaatgtgtaaacgcataaacacaatcagcaaagctttgcggcagtgcgctcacggcggccggatctgtccccatgcgatgaagcggtccccaggcgcgcttggctgatttcgggatctggcgtttcataaaccagcgactcaagaccggatttaaggccgccttcaatggtgctggcgtactggtcatcagcatccggcccggattgcctagcaaaatgagctgatccactcgttccggataaggcagtgcaaaccaggttgcccagtgtgcggccagcgagtgggcaatgatcggcactgttttcaaatcaagctgatccatgacttggccgatcaattcaaccgcaaagtcatgcaccttgacctgttcataatcaaagccgtcacttaacccactgcctggtagtgcgagcacaaataaatgataaccggctaattgcggcaacaatggcgccaattcatacggatcgccggtattgccagggatcatgagtaccggatccccgtgaccaaattctaagacgcggacacgcaaatttgcttctgctgactccgtgggtgcgattttaagccatcgcgttttcggttttaagtgaaaatcaagccaaagttgattctccgcattacgcgccgcctgaaaagcaaccgaatcatgttcaagaatgggttgcgtcaccaatcaattcctccttttttaatcctgtcctccagttagcgactaatctaagctgtcaaaccattcgtcatggaagcttgataaatcgctttgacgtcttcttcagataatggcacatacgcgcgggtttccagactggcattggccacagccgctgttgccatcgcgtcaaaatgcgcttcatcggcaattccgacttccggtaaggtcatcgggaagcctaaatgctgaatccagtcaaacgttgcgtcaattgctgcttgggcaaccgcgtatgtttcgtctccttcaaggtcccaaacatgccgtccgaatcgcgcaaatatttccgcggtggtcggatctttggtcaaaataaactccatccagcgcggtgtcaaaatgccgagaccaacgccgtgcgtaatgtcatagtaggctgataactcatgctccaaactgtgaaccgtccaaccattttcgttggccacgctcacaagaccattcaatgccatggtcgcactccacatcaagttggcgcgggcatccgagttatgcggctctttaacggcgatcggtgcccacttaataacagtacgcattaggccttccatcattcctttgctggcgtcattatttttcgaacggtcaaaatattgctcgatcaaatgactaaggatgtccattgaaccagccgccgtttgccgtactgggacagtataggtcaagctcgggtcaagaaacgaaatggcgggggtattcgggccagtggtacccaacttttcatgggttgccggattagaaatcacggagccgctgttcatttcactacctgttgccgccaacgttaaaatatcaacaaccggtacctgctgcaacttgtgccgcattatcccgcgatccttcaccaagtcccacgggtcaccgtcatagaatttggcactggcaatgactttagcagcgtcaatcaccgaaccgccgccaactgcaagcaccacgtcaatatcgtgttgctttgccaactgttgaccttcacgaatcgaggcaatttttgggttgggctcaataccagccagttcggtaacgtctaagtctgctaaaagccccttaacggtatcatacaagccggactttttgatggaatgaccgccataaacgaaaagaacacgtgaaccaaagcgactcacggcatcatgtaactcagtatcaagccggccggtaccaaagcgaatatcggtggcgttttgaaatcgaaaatttttcacagtgccatctcctatcatataatgtcaacttaattgtaccgttgttggcattaaaaaagaaaccggattcgtgccgaacacgggcatactgtcctcggcttaatttcaagatagccaatacaccaagccaaatttatgcgaaccatgctgcaaagaaacaatgaccctgatttgtaagcgaaatgccgatttttgcattcttatgttgttcgaaagccaaaaatacggcaaaaggaatgagtgacacctccccttgccgtacttgattcaatggtgcaacaaagtccaatgactgttacacccctaatattgccactgagtcattcttaatgtgctggttcaactggtaggttcatcccttgccatccttccaacgcacctgccaactcgaaagccttaaacccatgcgaaagcaaaatcaacaaggcttgtttgcccaaagtagtaccgccagtccagtcatacaccacataggttttttgctggtcgagttggtccaatttagtgacaagatcttttgccggcatggcgcgggcacctttgatttgtacctttttggcttgcgtcggtgcattacgaacatccagaacttcatatgtttggtcaccagcctgtaacgcatgaagaactgtgaagtgatcaatgtaaagacttaagtaggtttttaaaaaatcaattttagcttgttccatcatgatgtgcccctttctgagggtatatgggttacttggtcccgagcagtaatttatcgagtaatcggttgagttgtatttgttcatcgtgggttaggttggcaaagagccggttaaccgtttgataattcaccggtaaaaaccgatcaagtaacgttgccccttctgtggtcatctgaattaaagaagcgcgtttatcagctgcggtcgtcgtcttctcaaccaaaccacttgcgaccatgcctcgaactaatttactcgtggttgctttagttgccccgagcttttcagctaagaccgtaatacttaaagcttgcggttgttgatggtacaggaacattaggatcaaaaagcgtgattccgacaacccaaactgatccagaacctgttgatagtcattggcaaccgctctgaagcaagtgcgaaaattcagaaaagtcaagactgattgggtatcaacatcgggataaactttgcgcattaggtcaagccgatgttcatccgggcgatcagtaaagtcaaaattcaaaagtcatcctcctcatgttgttagccggctaacaacatgagtatgtaactcattctcacgcgtgtcaagcaatgttttatcgaaaaatgggtttatacaattgttattcgatgatgactttgaaaatgcttagtcgtgatgcgaagacagggtatttatatcagctatcggttgtgagcacagagcacgactttctactctggaggatttgcaagtttgatcttactctctataacgtgttcgtcagtccagcattctgcgcttaaaggccttaagcgcagtgaccaaaccccggcaggccgcttacactccaattgctaaccgcgccggctcgcgctcacaccaaaaaagcccgatcatcatcgggcttaggatgctgctctgaaactaatgactaactttgacggcataaacaacgcgaatcggggttgagcggactcgcagtagacgtgctgcctcttggttgccatggctggcgcggatacatagcatgcgtcgggcctgtttagcgactaacagggttggaaaatcttttggaaatagtaaagcgaacaacgcttcgttcgttgcgccaatcaatgataagggacacctttctgcttgctgtaatttgtgcatagtgtagcatgtttcttctcaggcgccaagagaatcttgaatgttttcgttattttaatctaaatgttactttagccatccgccaatcatgaaattgggttgaacacagaatttttcagaacccttacctctgtatgtaaagacgaataagctggggttcgcacggaccatcaagttcattgcaaagcggttaacaatcgttccaaggtgacggtaagcgcttcaggatctttaacattggtggcgaaagctttttccagcacctgaaacagctcatggacttccgcagccgccgcttgtccatcagccgtcaaaaaaagttgccgctcgcggtcactgtgcggcgccatccgtttttctagcagaccttgttgaattagccgcttgatcaggttagaaacactcgccgggccacgacttagatccacgctgatctggcgctgattcgtaccgggatgtgcagcgacaaaagtcaacaccttagcctgatcgctatttaagttgagtgtgccgagatgttgattaagaaaatatttttgtaatttagccagctgataaatcaagccggaaatgtttgtttcggtttgcatgtcgaacctccatacccattagcatacacgtttgacttgcaaacacaacagtttcgttagcgtcttttctctgaatcccaatagcaaaccgcgtcacaattgaaggacatccaaaaagacgcctgccacaatctcattgtatacagacgcccttgtcttcttggcgcgattaatcatcgctgtctttaataagctcccatttgcctgaatcatcatcgtatttgctcatttggtcatgaatctcatcgtagcggtatttattgtacagttcgccactatctttgtcgtaaacatcgacttctttcatgttaaccgctggcgatgtgacttccacgcggtaatcgtcaagatcaaaatcatccagatcggcggccattttggcaacatcgcggttacttagatcgccgctgctgctgttgtcggtctcatctgagttatcgcgactttctgcacgtgacgcgctggcattagcgagtgattcactggcggcttcttgagacgctgccagtgagctagatgctgctgcctgcgatgcggacgccgaggctgaagcaattgaggctgaggaggcacttgctgctaaagcactggccgaactcgaggcggcttcttgcgtctgctgactgcgattttgaaaatataagacaccgcccacaatgacaaccgcagcgagtaatgctagcgtcacaattagccatggtcgtttcgggtggttgggggatccgccactggtttgtcggcgacgggtcaccggtggcacgctgcctgattgtggtcctgacgccgatgctgagctcgtctgaccgccaacattttcctgctgattagctagcgcagcattctgattttctaatcgataggccttaagattgaaaccgcaattgtgacaatatgcttcgtcagcgctaacctgaacgccgcaatgtggacaaaattccatttctacttcctccgtttttgatatttggtatcttactaccctgtcatatcaacgattgaacgccaagctagcactgacgatcgcaagctgtatgcgctactcacttatttttttaggaaccggcagctgtcgcaacagccattgataagcttcaggtaggatctgttgccaataagtaaaaccgtgcgccccagcagcgctccagtgcgtagtcggatttaccccggcagccgtgagttgatcggaaaactggctaacatcctgaaatgataccgttgtatctgcctgaccggaagcgaggaaaacgtgcaacccggcagtgcgatcacctgtcaacattttagccggcgcttctgcttcccactgtgcctgattccattgtccggcacgcaaaaatgctggcatccgtggccgcgcagcttcaggaacttgttgccagacagccggtgacagtgctgcaaccgtgcgaaatgctgtcggaaccgctaacgccagatgcagtgcgccataaccgcccatcgacatgccgccgaccgcatgggcatccgcctggggcaatatggcaacttgctgctgcaaatgcggcaataaatcctgcacgatcgctgtctgcattttttctgctggcgaatcaacgtaaaaactattgccgccatcaatgaaaaccacgactgcgggatgcttagtggctgtcaccgcttgatctaacatggtttttgaatcaaccaacttcaccagattggttgcatcaccatccatcccgtgcagcatcaagataagcggatactggcgtgatgaggtatagccagccggaagatacgtgaaatagcgccaggaacgattcagcgtcggcgaaaagaaacttgactcattgagactgctagccgcttgtggtgacgtgacactcgactcagatgaagttgatgcgctgatagtgctgcggttaacgattttggaagcagacgccgatgtcatctgccgtggcgttgacgttgaagattgacccgattttgaaggtgcccaagatggacccccccagatcaaaaatacgaccgcgatcatcaaagcagtgattaaaataccaaagattcgcttacgccgttgcatggttgtgcaccttaacccaagccaatacgttcctttgtttcggtttcaaacccttaccccataactgcctcttgtgaaggacttctttatcgtacaacactcaacaccaatacagaacatattttattttatcgcaacaaacgttcagttgcgaaacgcgtcaatcacgtcgcaaaagccgtgccgtgacgaccatcactaatgcagcaactatcccgacaacataaccaataccaggattgagcaacccttgaatttgattcgttccgctgctcattaacggtgcataggcaacatataaagccgcataccctaataatcctaacatcccgccaagtcgcatcatgccgcgcgcccggaaaagcccaaacactaatcctaaagctggccccacacctgccaacgctagcgctacataaggcagattaacctttgccgcacccactgtcccagtggtagcagccgtcgtttcggccaatgtactggcactgcgaaccaagtcatacaaactgccgcccaccgttgtcgtaccaaccccgctcgctccaaaaggccaagcataagcggcaattagggcaagaaacgcggccgctaaataaaccagccagatcaagctgccgcgccgatgtgattttccggcaaattgcagccaccaacgcgacgaaccgccactttgggaattaggtgaaaaatttggctgacgattaggcgtcgaatacggaggcacctgactagcttgtccagatgaaggcatcgtccaaatatcatcatcatcggactgatcgctacgattccgcggctggtaaggtgccaccggtcgccggttcgccacgacataaaccgccaccgcactggcaactgcaagcacccaaccgatcaagaccgaaaagctaaagacacaaaataacaccatgacgccaattaacgtatacacaatgtgaacagccagccaatcaagaaaatgctgaaagctgtcgtcagttaagtctaggcttttcttaccggccggcgtctgactttgacgtcgccgagagcgctcaccaactgttggctccttgtcagcaatcgaatcttgcggctccgcttgtttagtcggtcggctttgcgtggattgtgccgctgtttgtgccgcaatttgggcatcaaaacgcaccaaatccatgccgcaatttggacagaacttaacgcctgccggtattttaaaaccgcaatttggacagtaccgcatctttccagccaaatcggtttccctcccatttttgttgtttaaatccatcttgcctgcttccgccaaaatagtaaagtttctgccaactttttaacgaaaagcaagcgattttgcaaaccatgaatggcatagtcagcagtcatcttgccgctgaatttttgtgaaaatgaacattggctgcttccaccctcacttacttatgatcgttccgaaacaaaaggaactgggacacaattctatctcaggatgtgatgcttactaaagtccgaatactttaatagaatgggtcattaaaacagttccgggccgtgccaaactccgcaatctccggccagatggggtggcgacgcgaagctagagcggagacggcgcttggagcctgcaagcccggcagtctccaagtcgcctaacaacatacccccgcgacaaaaaccggtcgctgtgttgtttccacggctgagccccatctggcctacgattgctccgccttggcactaaagtccttaaagtctatttacactaatgtaaggaatctaaaaagcaaaccatttctcgattttagcgagaaacgattcgcttttattttgaagctgtgaattgttgctcagcctctttaagttactagcttattctagattaagtcagtgcatccgctacttttaagcttttcaagcggaagcgccatcttcacgacaaccgcttaaaaatggcggtcgaagccatggggaccacctgccccaaagctgccagggtagccgcggcggggaccatgatgcccgtgatgaaagcgctccgcccacgcccgcatatcgtcaaactgttttccttctggccagctgagatcatcgcgattagccaaatccgccgttaatttttcaattaatttcaacaactcagcttgttcatcgtcagtcaaaccgctaaaaatttgatccggtaaatcggttttcagctttccggtggtttcaatgaatttgcggccatcgtcagtcaaagcaatgagttgaacccgtttatcggtttccgattcatggcggttaatcaggcccagttcttccagtttctgcaccaaagccgaaaccgagctagggcgaatgtctaaagcttcgactaaatccgagttcgtcagttcaccgtgctgatcgagtaagcgcaacaaacgcaattgattaggttgccgctgctgatcaccaaaacgcaggctgctggcgatggcccccataaatggccgcttttggagtaattgcccgaatgcttttaataatgcttctgaagtttgtgtcatcacacttctccttttgaatacgaggtttttaaaagttagttttgtttatatccgactaactgacattagtatagccatctatttagttagtgtcaattaagactaacataaaatcatcaagaaatttgagtgaccgcctcaaaacaacccctgagactgtcgaccacaagttccagcccaatgttgtaatgctcttcattgccactctggttccaaatgctagcaaaaagcccgcccctatcattcccgggcggactttactttattgaattgctaactttttaatgttgccgttccccatccagataagcgcgaacgcacgcaatcatgtcgcgtgattgcgtattgaataatggtggcaactgatcgaagttaaaatacttcaaggcaagcgtctcattcggatcagcttgctccaaaccgccacccactggctttaccagatatagtcggcagataatctgggcctgatcgccatttggatacgtggtaaaaccctgctcaaaagtgtgtaacggcttgacaggttcaaccagcaagccggcatcttccttcatttcccgtttcagcgtctcaacaaacgtctcgccatactccatcatgccaccgggtaaactccaatttcccgcgtctgtacgctgttgcagtaatatttgtccttggtcattgacgacagcacccgcaactgcatttagaaaaatcggcatatgcccgaccttgctgcggatgtcttttatataatttgccacttggttgcctcttttcttgatttcattacattgattattcaatagatgcttggcaagtgcaagcgactcatcacccggatcaagatttcgcacacagttgctggagccaaaaactgacccgattttctataaaaaattctaagcaacaccatacaaaaacgaccatcaccctcaagcgtcttatcaacgctcaagggatggtcgtcttttcaattatgcaaatgagttagcggatcattagtccaacttggtcttgctgttaacgttcaacttttcatcaaagtcataaacaaccggttcgccagttgccatttccaagttcatgatgtcagcatcggaaatgttttcgatgtacttggtcaaggcacgcagagagttaccatgtgcggcaataacaacattcttgccgtccaacagatctggtgcgatgtggtcttcccagaatgggataacccgttccagcgtcactttcaggttttcgccgccaggaatgatccgcggatcaaggtcggcataacgacgatccttagcagcagagccttcgtcagttgccttcaacaatggtggcaaaacgtcgtacgaacggcgccagatgtgaacttgatcggcaccgtatttgtcagccgtttccttcttgttcaaaccttgcaatgcgccatagtgacgttcgtttaggcgccaggttttcatttctggaatccacaattggccggattcttccaagacgtagtgcagggtcttgatcgcacgggtcaaaactgaggtgtaagcttggtcgaattcaagaccagcctgcttaattaattcaccggcatgctttgcttcttcgacacccttttcactcagatcaacatctacccagccagtgaactggttggacaggttccattcactttgtccgtgacggatcaatactaatttcgccatatcagagaatacctcgcttttatgatttgacagtcttctgcctgtttacagaatctcatgttacaccattttcagtaagttcgcacccgctttctctggtatattggaaacatagcaaaaagaaaaggtttaacaacgtttgtaattggtgcatcagttacgacacacggtgcgatgtcatcggtagcaaccttgtcagtacagggtgccgctgcgcatcggattaatgtcccttatgacttatgtgctcagtaatttggaggttctcgtgaaaaaaatttggctcacaattggtggtatatggttgatcagtgtcatttattttttgatttatatcaacttaccggcgatgcaactggcagtgaatgaaaacggctttttatcgttggttcatggcatcatggatctgatcttacttggcggtacgtttgccttagttgcaggaggcctttatcgtttatttcatcggcggtaagaaatttcccgtcattttagtcagtattgtgtctgtcttttgttatgattaagtgacgattgtttttgaaaatggaactgggtttaactttggagggaatatcatgtttaaattatgtccaaattgtggggcacataacgcacccactgctaacttctgtacaaaatgcggtgcaaatctggcgggggtggccgccactcaaccgcaagctccggcaacccctgacacaaccaacggagaagccgataccgttagtgcgactagccaatcacctgtagcaaccgcaccaacggcagacgcaaaatctggagcagcaccggaaaccacgaaaccgatttccactcaaaccacccaagctgatacggccgccgattcacaagctgcccaaagctcggaaagctcagcggccgcaacgcaaactgcgccgactaccgacaatactgctaccgatgctccaaccagtcaggcccctcagccaacgccacagcctaatccaaccgttgaggctaccaagcagtatgcgggcagttactggcggtatttagtcgatagtattaagcatccggccagcattgagcgcacttatcatagttattttggactgaccagtctggcgattaccatcgttagtctggccttgacgattgctttgcgcgccggctcggctttttcatccttgcccggcagccttgccagttctgtcatgagtacatttttgaagttgctggtcttagttgcgattctggcgattggcgtgattgccatttattatctgggcgttcgcggcatattaggtgatcggcggcgacgttttctcgactttacgacagattatgcgttccactgtaattggatggtgttcttctccgtctttaccctgttaatgcagatattgggtctcatcaacgttggttcggcaatgttaatttcgttattattgaccatcagtcttagcctctttttcttagccggtccttatatgctatttacggctcagtcaactaatcatttcgacaagatttacgcccttctcatcgtcagtgtgctactagccattgtcttcatggtgattaccatgtttggtcttgccagcatcatgggtagcctttatcaaggactcaacgattttggccgctcgtttaattactaatacagctggctcaatcgcgtattaaccacctggaatgcttgtgccatcagtcagacgcataaggcactcgcgctaaaaaaacaagcaattgccgttcaacccaaaactggtcctaatgacatctatcttctgtcattaagaccggttttcatgttcccgcctgtttattccactaacgcttctaagttctgcgccagcgtcaccgtgtcggttgtcatcgtatgattaccaaacaacacaacgccgctggtcgcattagcacgaaaataagcaagggtactgaaactttccggattgtcgttgtacatgccttgcaataaacgctgatcgtccaaccacgctaccccgctggcatactgattactgtctgcataatgtgccgcgattaactgatgatagacttttttaggaataatcttcccggtttctgctgcaatgatcaccttggccaagtcggtcacgctcatgtagacactcccactgccaagtaaactcgacaaaagcgcctggcttaaatcatccggctggtacgattgatcatcttcgctcagataaccttgcgccactggcattttcgccgataacgcatcgaagttacgggtatgtgtgagttttaacggtgccagaatcgtttggtctaatgccgcagcgaaaggcttctttgtgactttgcgaataatccccgctaataacgcataattggcattagtataaataaagctatggtcgccggtggatcctagttgattcaaattccagtcgagcgcgtttttttctgatgtcagtatttgctccggtgtaagttcatccatttgaatgcccgagcgatgatccagcagctgccgaatggtaatgtcgcgactatgatcaatgtcgggataaaacttggctagcttagtggtgaatgacagccggtgatcggcaatcagtcgcccaatgacaagcgccgttaaatacttctctaccgaggccagcggaaacatcgtcgccccattattcgccaatttgcgcgtatgatctgcttcaccgacaccgcctgtataaacaatccggccttttttgatcaaggcaacactgcctctaaagtcggtcgcatcaatcagtttgcgaacatgccgccgcaactgtgcttggggaaccggtcgcgccgtaatcttactggcttgacgctgatgctggatccagcccatcgtcacgccgccagcgacgaccaaaacacctaacaccgccaaaatgatcagccaccggcgtttacgcgtcattttcatgatgctcctttggctgtgggacagtgtcataagtcgaatgatgtgctttggttccggcaatctttttgacccctaagacatccaggaaaaaggtgaagatcggaatacctacgatcaagccccaggtcccaaagagtcgttctgccaccagcaacacgacaaaggtgaagaagacaggcaattgcgtgcggctactcataaacttaggattcaagacatatgcttctaacacatgaatcgccgcaatcatgatcaaaatggtgatgacatcttgccagccgccaactgtatagccgatgatcgtcaacggaatgagcgaaataatcgccccggcaaccggaataagcgataacaggaaaaccataatcgccagactcggaatattcggcattttcataaacaacagcgtaatcgtcgtaatcaccgtgttaaccaccgcgataaagatctgggcttccatgacaaccccgaacgtattgatgaatttcaaggcaaaataacgcagatctttaaagtaccaaccaaacggtgaatccaaaaacagttgcccaaatgccggtaagctatccaactcgatggtaaagaagaaacttaaaataaacgacaacaccaacgtcaagcccatcgcaccaatgttaccggcatattcaagaaccgttgacaggccagtcttaagttgttcggtgaggttcaggctcttggtactctgcaaaacccactgcattacctggttgttggcaaaggcatcgctgttataaaaatcctgtaccgaattaaacagcgtgatcgtttggtgaataatggctggaacataatggaccgctgcatagatcaaccctaaaatcaccaatatgtaaacaggtacaacgatcacaaacggccgaacatgaacatggcgttgaaccgcgtgcactaagcgactgactagaaacgcaaaaataaaggtcaacaaaatgtcgctcataatgctacgggcaaaccacaaaaccaaaaaaaccgagaataaaaccactgtacgtcggactggcacattgttgataaacttttcgtacgctgacatcgtcttccccaccatccatttttcgctagttaaatcttagcgtgccgcaaaaataaaaaaagtgcaagcattcgccagcacttgttcaaattataagaaaattttcagattcttttgatttgctttcttgaccgactgaagttctccttgcacaatgatccgatccacttcgccttctgtcggtgacgcacatgtgactaaggtgatcagtttcttccctgccacatcatcgatccattgcacctgggtttcgttaacaatctgtttcgtggtcactttgtaagtgtaaactttcttcatattcgtaatcgcgactgtatcgccagtttggacatttttcaaaggtgaaaaaagaatcccttggttggtcatatagtggccggctaacgcataattgccttcacccatcttctgatcagccttcatcgtcccggcgccggcactcaggttatcatttgacagccccttgagaatcggcaacttcagatgaacgctggtaatggcaatcttaccaatcggatgcaggttacgggtcaacgcggcattcccgaccgtgttgatatcaagcgctttaacacctttaaaatcaaacgtggcacttcttttttcgttcttatcaactgtattgcgatcaatctgccccatcgtccattggcttaaatgatcaacgacaaacagcttaatcggttcgttgaaaaccagcgctaagcccagaaggacaccgagcgcaaaaatcgtccgccatagccagcgatgcttacgtggggactgttgtttacctgatttcgtcatcgttatcctccttgcaaagagcataccttgaaacccactgagattcaagcaggcccatgacacccaagtctcagcctttcgctaacaaattgtaagtcaattaggcggataaacgcaagtcaacagctcagtcgtttttttagctgcgcactgacaagggttatcgttaatgtcagtctcgcatgaaccttataaaaagcatctcactaccactcagcttgcatggtatactgacaccattcgtgcgcagccaaacactgcattgcatcaaactcaaagctaggagagatttaacctttgaaaacgctgattcatctatataaacgctacgaaatgatcatcaactacttatttatcggtggactcaccaccttgatcaatttcgtcaccttttttgtgatgcgctattttgatattggcttggtcttaaccaacacgaccgctaacattgtcagtgtcatttttgcattcttcgccaacaaaagtgtcgtcttccacagtgactattcaagcaaaaagaaattctggttcgagctaaccagttttctaatcctccgtggcgtttcactgttgctggataacttcattatgattgtcggcgtggactggcttcacggcaacgagatcctggtcaaaattctggatcaaatcatcattgtcgtcgctaactacctgttctcaaaactgatctttgtccgcaaacggtagctatgcttatcgagttctagattgttaactaaaacgtgccccaaaagtaaaaaccgcttttggggcacgtttgcgttttcatcaatcaaattcaacccaccgaaacatgatgcgccgctagaaacgaactaaacggcaccaaattatcagcataataacgtttcttgaaggcagcaattgtagcggcatcgaaacgatccggatctaactgcagatgctcgaccgggattggccgctcattcgtaattttggcatcaataagtgttggcttgccagcgatgcgattggcctcggcttcatcaaacgcagccgcgagttccgaaaccttggtgacggtcaaaccggtcatgcccattcccttggcaaccgttgcaaaatcaattgctggcatatcaacgccaaaccattcgtgtccgtcatcttcttgctcatcttcaatataacctaatgcattatttgaaaaaacaacattgataatcggcaggtgataccgcacttctgtatccagatcctgcatgaccatcgccgcggcaccatcaccagcaagattgaacacttggcgctgaggaaaactcaactgtccggctaaggctgccggcaatcctgcacccatcgtggcgaacagtccgctggttgtccacgcttgccgaccattcactttcaacaagcgcacagcattttgggtgacatccccgacatcaatcgcaaaaattgcatcatcggtcgcaatgcggttgatctggccaaataccggctcaaagcgcatatcgccagtggtccgttgcatcatgtcatcattgtactgatgccaatttttgacgttatcgacattggcctgataccagccgctgctaggagcctcatcactgtgggcaatcattttcttcaaagttgcgggtgcatccgctaagattgccacatctgtgtgatgccgcttgcctaaggttttgggatcagcttcgatttgaataaacttggctttaggcgaaaacataacttccgcaaatggataattcgagccgacaaacatgatcaaatcggccacccgcaatgcttcattggccggtttcgatgcgacccgtgcagccgaacccaagagtgcttcaaaggcgtacggaataatcggcttgcccagcgctgtcgttatcactggcatctgtaactttttggctagcgtcatcaccgtatcagctgccccgcgaacgccttgaccgacatacatcaccggccgagacgcggtacgaatcaatcttagtgcctgatccacctgttcatcagtgccggccgctaaaatcggggtggcatgggtcgccgcggcactgtaatacccattcgccggaatcaactcggcggccaagtcgttaggaatcaccacaatcgccgcaccatgagcagcatatgcccgccgaatcgcctcatcaatgacatgcggtaaactctgcgctgtggtgacggtacgtgcatagacagccgcatcctgaaacattggatcttcatctaattcctgaaagaaatcagcattcataaaccgttgttccacttggcccactaagaacaaagtaggcactttatccattttggcatcgtaagcgccttggaaaagatgcgttgctccggggccagctgacccgaacgccaccccaatatgacccgtcagctttccatcggcgaccgctgccaaggccccgacttcttcatggcgcacatgaatatacttgatgcgcgacttttcctcatgcaacgcgtacatcatgttattaaatgtgccaccggggatgccgtaaatgtgcgtgacgccccaactctccaaagtttgtagcgctgcaaccccagctttaatcgtctcaaccatcataagtcccccttttatttaaaaaccggcaatctgaacctgccagttttggcgtgttattaaagctgcttccgcggttatactaggcacgaaaagatgagaaagcaaatcatctgcctatgtaaaaacgccaaggatatgatccgtcttcatgacgaaccgtaccctcagcgttttaatgatggttacttcaaatcttcaatgctattgatattcttcatatactttggaacggccaaaccgacccgagcgccatccatattcacgccaagatcaacaacctggttcttataatcggcgtataacttggcggcagtgtttggcaaccacgccgatacctgtgcatctgctgctttagtcgcaactgatgcccaaaccggctgcggctccatcgcgcgaatcgtcactttataacccatttgccgcaaaacggtcgccacaacgtttgtggaggcaatttccgaatcccaggcaatataggtcagggttaatttaggactaccgctaacatgactaacacccttagtccattgagcaatttgctccggatgtttcttcacgtatgcttttgcagctgcagcaggatcctggccattgttcaccgccaacatcacactagaaatttctttgggcgtccagtgaaattgatcaagcacctggtaggcttgcggagcatcttgcttaagccctttacgcacaatcgtatgaatctgttcggctttaccatagacattcttaggatccttcaaaaatttcaacggaaacttggtgaacatccagtgcggcgtccagccggtcaccacaatgggccgcttatcggcaatcgccttttgcagtgtactggtcatcgccgcggtcgagcttggttgcaactgccaattcttttcttccagtccgtatgccttcaaggccttatcggtactgctcatgatgccggcacctgcatcgattccggtaatcgtatagttaatttgcggccctagaggctttttggcatcgtacttaggttgggtactgctgcatgcggtcaaaaagccaaccgtggctaccatcgccagtgccgcaatgatttttttataaaaagtcaaacagccacctcctagcgcgtgcgattgagactttgggtaatccgatccagaatgattgccagaataacaatcgccaaaccggcaacaaacccgccgccagcgtcgttacgacccacagcaaagtaaaccttggtacctaggcccattgccccgatcatggatgcaattacgaccatggataaagccaacatcatactttgattaatgccggccataatggtgccgcgggcaaagggcagctgcactttgatcagctgctgccaactcgtagcaccaaatgcaacggctgcttcattcaagtcagctggtacctgttcaattcccaattgcgtcatccgaactgtcggcggcatcgcgaaaatgactgacgcaacaacgccgggaaccatcccgataccaaagaatgccacggcgggaatcaaataaacaaaggctggcatggtctgcataaagtccatcaacggcttgacaatcgccgaaacggttttactttcagcagcccagatacccagtggaatgccgatgacaattgccaacaagcttgcggtcagaaccaaggtcagcgtctgcgtcatatcgcgccaaaatcccagattccagattaacaacagccccactaattcgaaaatcagcaaactgcgatacttctgccctcgcttaaggtaccaagtcagcgccataattaagatgataaacagccaaatcggaatgaaatcaaagaccgcttgaaaggcattgacaatcgttccgataaagttcgtcagcacaccgaagaacccggcaaattgagtgagccagtccacgaaggaatcaatccaatgtgctaatggtaacgttgggatggtaactaaaagattaaacattgacattgacctcctgtcctgagagtgcgccaagaacggcaccgcgaatgataatcccgcgaagtcgtttctgatcatcgatgacagcatacggaactgaagtagtcgacacagcatccagcaggtcagctaacggcgtatccatttttgttgtcggtacgtcggtcttaacaatcgtggttaagtcctttttcccgctatcaatggccgcacgaacatcatcggcatccaagattcctactaattgtcgcttggtgttgacaacatacaagctggaaatctcgttgtcacgcatccgccgtgctgccaaacgcggaccatccttgtcgatattcacggtgttagcgcgaatcataacattagctgcggtataaacctgactccgatccacaccttcaatgaacttctcaacgtaatcatcagcaggttgactcagaatctcttctggcgtcccgatttgaacgatctcgccgtctttcataatcatgatgtgatcgccaatccgcaacgcttcattcagatcatgggatatgaaaacaatcgtcttgtgcatttcttcttgcagatccaacaattcgtcttgcatatcccgccgatttaacggatcaagcgcagaaaaggcctcgtccattaagagaatctcggcatcactggccaacgcgcgcgccaagccgacacgttgttgcatcccgccagataattgatcaggaaattgatcggcaaacccgtctaatcccactaaatcaagcgctttgttggctttagcttcacgttcggatttatccatcccctgaatttccaagccaaacgccgcgttttgtaaaacagttcggttaggcaatagcgcgaagccttgaaataccatgctcagcttttgccgccgcacttcacgcaggtgttgcttgtccaacttggcaatatcatcaccatcaatcagaacttgtccggcagtcggttcaattaaccgattcagcattcgcagtgtggttgatttacccgaaccagaaagccccatgataacgaagatttcaccttttttaatggtgaaatcagcttgatcaacacccacggttgcgcccgtagcctttagaatctcagccttggttttcccttgctttaacatttctttggcacgattgattcgtttgccaaaaatcttggttaaaccactcacttcgattttggtttcagcatcattttcaatcttgtgttgcatttgctcactcctctcaggccccttaacgaattaagatatcgccttggtgcccggtactttttaaaatcgctacttacctgatgttgcgattttgttctgtttcagaaacagttgtcatcgaattgaaacaatgctaaccattgtacgagtcatttgtgtgtgattcaaatcacggaatctcattttcattttcaagacacgctggcgttttcacttgctgaaaattttagccacaacaaaaaagccctcatcggcataggattgagggctagggacgattgatgacccgctaatcgtgcatcgtaatcgttgtcaagttaatatgaaaatatcatgaccgaattctcatatttcacaaactcgtcaggttcatttccgtaaatggcagatgctcgtcaaacaggatcggctggcccaaagtaataaaatccggacccgtcatcgtgtcataagccaagacgcgcacaccgttttgcttggcagttgtgattgcggtgacaagctctggaaaccgttcacgataaatcgtcatttgctgaatattgggtaactgcacaataaaaaccaaaaatgcctgatagcctgccgcttgggccattgtcagcgtgtgcacatgcttcagcgctcgcgtggtgggagcatcgggaaacgccgccaatgtttggttggctaatgtgacgcctttagtttcaacaaaccatgattggccatcagccgcagttcccgcaaaatcaagccgggaatcgcgccaggtggtctcgggacgaaccgcataaggcaaggataatccgggcaatttcatggtgccagcctccaagcattctctggcaacgtggttgggggctaagctgtctatattaatccaacgattctgccggtttaccgcaagcagatcatagtgcgtcttccggttgggatgattcacataacggacactggccagcgaacccggcactagaatttccttattccggccagtgttgttcatatgtaccgatgtcgtcacgccatcaatcgcaagttcaaccgtaaaccgactcacgcgccggatcagttgcccgacactgacattttgatactgcataaacgctcctcatttcgattttgcctgacaggtagcatagtgcttattaaccgcgctgacttatgctcataacgtgtttgctggcgcagggatttgcgtgtaaggaccttggttgcagtggccacttatgttctggtttacgcccataacgcgctccccggcgcagaagtctgcgtgtaaggacctcaggcgcaatggccaaagaccggccatcacgcctgaggccacttacactccgatccctaaacgcgccggctcgcgctcacacaaaaatagcagccgcggactttaatcaaatctcacggctgcttatttgaatcatagcactgacaattaacggacaataataacggataccgctgcatcgcgggctacttcgcttgcaacgtggcccagtcgcagacggccacgacgtacgtgtgaacccatgataaccaagtccggcttgaacgctggaataacctcgtcaagcagtgccgctgccggtcgaccttcagcgataatcggctgggccttctgcacgccaaactcacgggctttttcaacataagtattcaggttcttcgccattttttcccgtgctgcttcaacatcctcaggcgtcaatgactgaaaaatattcagatcgccggtttcaagcaccgatacaatccccagcggaatatcatagatcttggcaaccgtgcaggcgtagttcaatgccttgcgcgaggagtcgtcatcatcatcatcaatcgccaataacagccgattataatgtacggattcaatcgttaaatcattttcagtaaccaaaagaaatgcccccttgcaagtttaggtgtccctaacatgtttattttatcacacatcgcctttgttttccgcaaaatactgcttaaagcgaccaacataattatgaaacatatatttcagtaatagccagcgtttaagcgtcatatctggtttgtaaaagaccgtcgtcccgtagcgcttttctttgatcaacttcaacgcttcccgcttggcctcgttgtcggcggagtattgcttgaagacccgttcaggcaccccaagccataatttgtacttgctgcgatcggaattgccataaacagtcggcgcatttttgagatcgccggtgatataatcgcgcaccggccagctggcaagattatagccattcagggtcacgaaaaagctgctgcgaccctgccgaatattaatttcaaataacttaaacgtgttgtcgcggtgatcatacttcatatcaaagttagcaaaaccggtaaacttgatggcttcgagaaattctttgatttgatcatacaatgtctgatcaaaagccggcataatcgccacataattcccgatggacgctggtgtgggatcttcaagtagcggatgacccagacacatcattttgacatgatgatattggtccacataacaattcaacgtccgcatattgctgtcatcacccggtacaaagtcttgaagaattaagtcagatgtatacccattgtcataaatcttggcgatggtgttggtcaattcgacttgggaatgaatcgtgaatgcctttttacgcccttcaaagtggatattcaaccattccaccgaatcggtcggtttcagcgccactggaaattcaaatggcgccgtaattgtggcgttgctttcatacattgacttggtcacgatcttagtggctgggtaaggaagatggtattcttcacaaacctggtaaaagctttccttactgttaaggcgttttaaaagatcatagtcaacatatggacagataaaccactgacttaattcatctttatgtttggataccaattgtgcatatgtgtcaccgcacgcaattagcagcagacggccagccgaagccgcgtgcagatgcgcaacttcacgcattttttcgataaaagtcgggtcagaatcaaattgcttaatcagatggacatttacgattcgtgaaaagcgtgttggggccagctgttcacgcgcatagacatcaatcgccccgccgatcatctcgtggaacgaacgcgccataccatacacgttcatatcactgccaagcaggatgggggtaaaactaggtgtatctttcatctgaatgataatctcctcgttcgattaggtgcgggcaaaagaatgccgggtaccatgaaattttcattgaaagtgcagtggcaagttgtctcagcgggtccaaactgcactaataattttccctgagcggttggtcaaaatgaatattgccttcagctcgtcgccccagaattataccatactggcaatctgcattcatgaagatactaataggataacagtttttcaagatttagacgcaaaaacgccaagtgtcagggcttggcgttttttgatattgttcagctttctgaaacccgcaccccttctgtactcggctggacgatctgcacgcgccatgctggccattgttggctggcggctgcttgcaactggcgagcagccgctgctccctcaacgattgcaagcatggtcgatcctgaacccgagatcaacaaaacgccattggctgcggtaaccaattgacggacagcctgatagtccggaatcaatgtggcgcgataaggctcctgcatccgatcatgggccacttgatgtaaaagcggtaaatcaccatctgccaacgcccgcgtcattagaacacatcgtcccatctgataagcagcatctgcgtaagtcatcgttgtaggaaggatttttcgtgcttctgcagtgctcacagcataatcagggatgaatgtcactaactgcaactgtgagctgaccggatactggcgcacaatgggctctgcatctgccaaaatagtcgcacacagctgaccaaaaattgcaggggcagcattgtccggatgcccttccattttcgctgcaagcttcaaaagctgagtccgatcccagccggcatgaaaccacgcattcgccgcggcaattccgccaacaacacacgtggccgaacttcccaagccgcgcgaactaggaatgttcgaatcgaccgtaatccttaaatttggcactggttgatcaaccgctttggcaaatgtcacaaatgcctgataaatcaagttatgctcattggcaaagtcgggatcatccccaaaaatctcaagcttttgggtgctcgcttcgaaggtgaaccgagctttgagatcaagggctaatcctaaaacgtcataaccaacgcctaaattagcgcttgttgccggaacggacacgctgatcattgttaaaaacctcctttgcggctgcaatgatcgcctggcccatttcttccggcgccaccacgtgtttaggttgggcagtcaaagttgccaagcgcgctagattagcaggaatcggaacaccactcatttgatgcaactgggtcatcacagcaaagtcgtcacctgtcaccggcaagtcaagggcttgagcaaccgcgcgtggaaatttgtatggactagccgttgcgagtagcacattaggggtcgaatcaccggttgtctcccgatattgctgcatcacatggtagccgacagccgtgtgaggatccaacaaatagtcgttttgcttccaaaccgcagcaattgaagctgcaatctgtgcatctgcggcaaaaccgccagcaaaatcagcctgaatcgctgccaaaacatcgggccgtacctgatagcggccggttgtggccaattcttccattaatttagccacataactgctatcttcaccactcttatagtagagtagccgttccaagttactggaaatctgaatatccatacttggcgccaccgtctttaggaacggacgattgcgatcataaataccggtttcaagaaagtccgccagttcatggttggcgttggccgcggcaattagttgatgaatcggcaaccccattaacttcgcatagaaaccagctaggacatccccaaagttgccagttggaacagtgaaattaaccttttgaccaagctcaatggcacctgattcaaccagttgcaagtaggcggaaaaataataaaccacctgaggaatcaaacgcccgatattaatcgaattggcggccgaaagcgttacttgttccgcctgcaaacgcgccgcaaaaccggtgtcggtaaagagatctttaacggcactctgcgcttgatcaaagttaccgccaattgggaaaacccgtgtgttattgccggttgtcgttaacatttgccgctcctgaatcggactaaccccatgatcaggataaaagacggtaatcccggtttgggcgacatttttgaacccttgcaacgccgcagtcccggtatcgccactggttgcggctaagatcatgatgcgatcttccggatccagtgccaggcgcatcagttgcggtagtagttgcaaccccaagtctttaaaggcgctggttgggccatgaaacagctctaaaacatgaaaatcacccacagaccgaacaggcgtcagccggcgatcagaaaaatttttatgataggcaaattggatcgcctttttcaacgcagcagtgttaaaatcaggcaacagggtcgtgagaacattctgagcaatcgtttcataatctttacctaataaattttgaagattcaagcggtaatccgttagatgcggtaaaacaaataacccgccttcttcggagatgccttgcttgatcgcttgttgtccagtcttgctaacgcgctgatcccgtgtacttgtgtatcgcatgtgaacgactcctatctgatccgacttgtttttggaataaggatatgataatctgttcgcattagaaaaacaagtgtctatattttatatacaaggagctgaagaaaatgaatattgccatcttaggttttggtactgtcggtagcggcgtttatgacatcgttgaaaatggtgatcgccgaatgcgggtcactgctattttcattcgcccaacccacccagctacgatgcctgagatgacaacaaatttcgacgctatccttgctgaccccaacattgatgttgtcgttgaggctattggcggcttgcatcctgcttatgattatatcctacgtgcactgcagcacggtaaacatgtggtgaccgccaataaagctgtcgttgcgcaacacctgcctgaattcatcacaacggcggctcagcatcacgttcgcttttattttgaagcaactactggtggcggcattccctggattcgcaatttggaacgtgctgctcgcattgaccaaattgataccatcgaaggcatctttaatggtacgagtaattatattctggatcaaatgcagcgggcgcatctcgattttgacccggttttgttggcagctaaagacatgggttatgccgaagccgatcccagtgcggatatcgacggtgatgacgtggtaaacaaactcaaaatttcggccgccttggcttacgatatggttccgccgcgcgatgttcctaagtttggcattcgtaatgtcaccaaagccgatattgactttttcgccagtcgtcatcaggttttacgactaattggcaagagcagacgggttggcaaccattatagtatggtcgttgaaccgcgcctttatccggcgactgctttggcggctaacacgtttgaaaacttcaacctgatccgactgcacggccagaccattggcgatttgcagttttatggtcaaggcgccggtaaatatccgactgctaatgccattgttcaggatcttttcgacattctggaaaatgccccgcatctgacgcggcactttgatcagaacttacaattcgatgcagatctgaatactgctgattacttgctgcgagccgatccgatcacgtttgccatgtttaacgataaagacaccgaagtcgttcgggatcatctcttaatcaaacaaatcccgaccggcgaaatgcatcggctcatgcgtggcgttttggcaattgacgctcatgccttcatggcagccattggcgatagtgaactgaccacccgtaacgttaaagaacaagttgatcagggggtaatcgaatgaaagtcgttaaattcggcggtagttcggttgccgacgccgggcagtttcaaaaagtcaaagccattatcaaccaagacccgcagcgccaaatcgttgtcatcagtgcagccggtaaatatggcgatgcaacccgcaagttgactgataccctttatctgattgcggatggattcgaagccggtcgtgatgtcaccccgctttttgctcaagtggcagcccgactggaagctatcaatcaggctttacatttgcatgtgccgctcataaaactcatgaatacgattcgtcatcacatcgccactcattactcgcgcgattatctggtttcgcgcggtgagtttttaaccgcccaactgatggctgcctatttgggctataccttcgttgatgctgctgatctcctcttttttgatcaaaacggggcgattgatgaagccaaaacattagctgcttatcggcggctaccgcgtcatcatgggatagttgttcccggattctacgggcaaaatgctgccggtcacgtacaaatcatggcgcgcggcggttccgacatttccggtgcgtggttggcgcggctggctcaagctgatctttacgaaaattggaccgatgtttccggaatcaaaatggccgatccgcgaattattcaagatgccgatagtattgacgtaatgagttatgatgaattgcgcgaattgacctacatgggcttcagtgtttttcaggaagaggcggtccagccagtgcgagaaagtggcattccaactcgcattcttaacacgaacgtcccagaagatcccggcaccttgattattcaagatgatgatccggcaaatgatatgcggatcattaccgggattgctggccgcaagcattatctggtggtgacgattcggcaatatcaactcgcattacacctcgatatcattcagcatgcactggacgtcattgctgaccatcatctggtcgttgattatctccccaccggcattgacagttttagtctgttaattcgcgaaccacgccatcagatttccgttcacgaactcacggcagcaattaaagcagcgtgtcagcctgataaactcgaggtcactgaaaatgttgcgctcattgcgatggtttcccgaaagttacggcaacgaccggcaattgccggtaaggtcctcgcctatctagacgacaacctgctcaatgtccagcttgtcagccagaccaatgatgacatcaatttattaattggcgtaaatgataaagactacgacaaagccatccgcgtgatttatagtagtattcatcaaaattttcaccgcccggcgccatacattgaaggaattgcttagcgtattaatttctttagacatcaaccaaaaagtggctccgttgcgattttacaacaatcgcaaacggagccacttttttaattaagctcaatcattctgaatttcactcatgactacttttgcttctcggccatgcgcgatggtgtacttgatgccgcttgctcggtagtggccggttgatcactctttggcgccggtgctggttgcttggtgtcaggcgctttggctgctggttgctcgtggtgcttgatcgcatcgacaaccggttgattaccagcctgatgcatcagtgcgccatttaacatcccgcgaatatcgatgccggcaacttcttgcaacatgtccagttgcttgaccaaactgccgctggtttgattcgtcaggtcgccatcgccataaagcttgatcgagtcaacatttgcatacggactcatagcagcctcaataatcttcggcattgcttcaatcgtcatcttgaagcggccagactcatcaagttgccgtgctgcttccgcttgtttagcaatcgcttccgcttgagcaagcccgatcgccttggtcttgccggcttctgcttccccaatcgccttggttgcatttgctttggcttcggcatccaattcaacctcttttgctgatgcttcagcggccgcgatctgggttgctttttgggcttcggcggcacgctgggctttatacaagtccgcatccgcttgtttacgcacggttgcattcagttcctgttcctgcaactcggcgttcttttgggctaattcaatgtctttttctttttgaacctgcttggccttcatctgttcaacaatcgcggcctgatcagcttgcgcctgggcaatttcttgttgctttttgaagtcagccatcttgacctgctgttcccgttcggcgtcagcaatttgggtctggcgttcaatttcctgctgctttgcttcctgatctgcttgtgcctgttgaatccgggtatcgcgattggcagctgcttcggctacagcggcgttcttcttaacttccgcaatctgcttcttacccagtgagtccagataaccgttcttgtcggcaatatctttgatcgtgaacgaaataatctgtaaacccattttggctaaatcggaactcgccacatcctggaccttttcggcaaaggcatcacgattctgataggtatcctcaaccgttaatgtgcccaaaattgcccgtaaatggccttccagaatttcggtggcttccgaattaatctgctcgtcatttttgcctaaaaattgttccgcagcggttgcgacttcttcctgactggagcctatttttaaaataaccgtcccgttgacgataatcggaaccccttgttgcgtgtagacttcaggcgttgcgacttcaatggtccgcgtatttagacttaaaacgtcccagcgctgcaaaatcggtaaaataaaagacccgccgttggtaatcaatttgacacgattgccattgacatcgcgaaaactgtgcttgccggaaatcaaggcaccggaaataatcagcacttcgttaggcaaagcggtcttacgatgggtggccagaaaaataaagagcaagatcaataaaacggccgcaataatccacggcatataatcagttaaaatttccatcagttccctccttagggttgtgagtagccaaggcatcaacataggcaataccttgtttgagttcaatgatcacgacttttgtgccctgatctagcggctggcttttatccgaccacaacttggccggatatgtctggcgggcgcgtccaccaccggttaccatgacttcgccagtgtgatgatgcgccacatctaacgtcagcgtaccgagtaagtaatcccgatcgctcattgatgtggtgttctcaaccggcgacagtagccgttgcaataacgctaataacggtaacagcaccagcgataacaacatccataagagaccgccaatgatcaatagcgccaccaccccgacgatcatctgtaaccacagttcttgctgtgcccaccatgccaacacgacactcgcctcgctttcaaagggactaaaatcttcctcattttatcatgtaaacggttatacgcctataccaataataaaaatatttagtggtgctttgcatgctgactgcggggccaacaccccgtctctatgtagtctcggtggcatgaagaagctactctttgtttgccaccgactaaagcttcaaaagtcacgtatgttgcgtgaatgcttttcgacctgccattagtcgtaatgcaaggcatagtcttccgatacctgatagtgcagggttttggtaaacagcaaattgctaagataggcgagtccaatcggcaagatgaagaaaatgaccgtcaattcgagcacattccccaccgtcaccgccttcattgcatcaagtgcagcaagtggcccgactaaaccagaaaagccaaatccggcactggcaggcgttccttgaatttgcaacgcggcgccgataccaccaagaatgccggcattaagcgccatgggtaagaagagcttcggtttagacaagatgttggccatttgcattttcggcgagcccagaaaatgtgccagcgatgtcccaagcggattcgctttccagccataagccgccagcgcaaaacttgccccgacaatgccaaggttagcagatccggcaccgatgccgttcaacataatagccgttgcaatcccgactgtactgatcggcgtcacaattaaaatggcaaaaatgatccccatcaaaacccccatcgcaatcggctgcaattcggtaatatcatggacgacaacgccaatatacttcgtgattccggaaaccggtttgagggtgagcatccccaccccacctgcaatcagcaatactaagaagctgtttgaggtctctattgacgagcaagcaggatccctataaaggccatagcaaccatgactttactggtatttaacttgcgttcgcaattgaacaaaagccgtcgccagttggttaaccaactgaaactacgttccacgacccagcgctgtggcgttacttgaccgttcttcagatcactttgtttggcgataatgacatctgcaccaatgattgcatggaccgactgggcgaagttgtcgcctgtatagccaccatcggccatcactcgctgaacaagatcaaactgctcttcatttaacgcgagtaaagcgatcgcaccgtcccgttcggagacattagctgtggtaatgtggatcgcgaatgggagaccattaatatcaacggcaaggtggcgtttaatcccactgattttcttgccgccatcataccctttattttggggtgttgccgtatttttgacgctttgcgcatcaagaattacgaacgacgttcgtaccgatcgtcccattcgtaatcgctctcgagcgacaatttttttaaaagcaggtcaatcagggaatattccgaattagctaatggttttgaccacatggcaaagtaagtgtaaacggtttgccatttcggaaaatcatgcggcaactgacgccattgagcgcccgtacgaagctcgtaaagcactgcattgaagacatcaaataggtccacccttcgaggacatgtacgcttgcgaaacgtctcaaggtcaacgcgaatcaattcaaattggtcacgagtgatattgcttggataatcagtcataatgaagtccttttttcacatattttaccggaaattcaagcgtctttcaaagacctcaaacagtttctaacgatggaatcagaagaatcgtgtacgccttgagcgcattgcccaacaataaaatgactaaatagccaatggcgagggtgatcgccaaattaatcacatccccggttccggcaacactcaagctggttttggtcagatgataattaccggcaccaataatggcagccagtgccagcgaacttgtttgaatcggcgtaaacttcgccagcattcccacgcacacagccgataacgccggtaacaaggtcatcgcagcggtcgtcatatacgtgacaacggccaactgtggaaagctaggtaaaagcaacttgacgagcgcatttaagatcgcgccaggaaccaaggcaacaataatccccactgataaaccgtttaaaatgttcatcgtcacggtttttacatcttgtttcatcgtcttcctccgtttaattaacttggtgcggtgaatgcccaccgactaaaatagttttgacgtcatccaatgaaatatcgatcatgtttttcacggctgcatccgtataaaaaccgatatgcggagaaatctcaacgttcggcaaagcctttaaagtttcaagattggtattgtccacgccggattggctgcgatcaaccccaaaaataccggcttcaccttcaattgtgtccaaagcagcgccggcaatctcaccacgttgcagcgcctcaatcaatgcggtcgtatcgacaatcggtccgcgggctgcattgatcaagtaagccgtctttttcatctttttgaaggtggcggcatcaagcatatgggtggtgatgtcgtccagcggtgtgtgcacggtgacgatatcagccgtggccagtaaggtgtcaagatcgacataacgaaccgtatccgccaattcagggcgcgttaccggatcagccacgatgacggtagatcctaaggcgcgaaaaatgcgagcgacggtactgccgattttgccagcgccaatgatgccaatcgttaattgatgaacttcctgcgcttccagaccaccccagctataatcatctttggcttcgcgcgccgtagcctcacccaaatggcgaatcaatcgcatggcatgagccaaaaccagttccgcaaccgatcgcggcgagtatgcgggcacattggtcacggccaatccattggcagccgcagcatcgagattaacaatgtcatagccggtaatccgcaaagtcaactgcttcatcccgaatgacttcaacttctgataaacaagcggttctggaatggcgccatgctgttgaatgacaaccccatcgtagcccttagccagatcaaccgtatcagcattgaaggcaacggtattggtatcaacttgaatatcattggcagcaacccagtcatcaatcgctggttgttcgtctggtcgaacactatacattaaaattttcttcatcatcattcccctttgagcgcgttatcgtccaactgcaaacctgcctacctaatgcgttgccataaactgcttaatgcgctcagccgccagtttcaaatccgccatcgaggccgcatacgaaatccgcacataaccttcaccgcctgggccaaaactggcaccgggaatcacggcaacctttgcttcacgtgccaacgcataaacaaacttccagctgtcatggaaccggtctggcaacttagcaaaaatataaaatgcgccatccggatgaggaacttccaagccggcttccggtaaggccttcatcagaaaatcgcgccgttttcgataagcttgcttcatcggctgactatcttccatgccattcttcaacgcctcttcagccgcgcgctgggcattggtcgtgacgctggtaatcgtaaactcgctaaccttgccgatttgttgaataatcgcagccggccctgccgtgatcccaacgcgccagccggtcattgcgtgggattttgagaccccgttaaggacgatcgcttgatcagggagtatctcgcccatcgaaacatgcatcccactgtaggtcaactctgaataaatctcatcgcttaagacaaaaatttcatactgcttgatgacatccgctaatgcgctcagatccgcgcgattatacgtcaccccagttggattagtcgggtagttaagaatcaccgctttaaccgtgtcccgattggcttcaatcgcctgttgcaatttttccggcttaagaatgaacccatccgccgaagtgtcgataaatattggttttgctccgtttaataacacgattgggatgtataaaggaaaaatcggagttgggataatcacggtatcgcctttgttcaacatagccgttaaactcgaataaataccgccagtagccccagctgtgattaaaatctgtgtctccggatcataggaggttttatactttgttgccagataatggctcgccgcagctcgtaatcccggcaagcctttgctctgggtataatggctctcatcattttcgattgattggatgcctgctgccttgacatgctctggcgtcggaaaatccggttcacctaatgtcagcttaacaatgccttcaataccgctgatttctgcattgaattgtaaaatgtcgctcggtttgagttgccgaacctcgtgattcatacgatcgactaatgccatgaaaatccctccatctttttacatccagtaagttgaaactaaaataaaagccccgcagtcatcgattgaccgcggggcacgaaatgggaatgattctcctgattccagccacacagtcaattgcttgatctgtgtgaccgctcactcaaaggtaactggtctcacagatcgcgtctgaaaaaccagaaataaaatgattggctaccttgagtcagctttgtcatcatgatgagaacctcctaagaaactgtttgaggtctttgaaagacgcttgaatttccggtaaaatatgtgaaaaaaggacttcattatgactgattatccaagcaatatcactcgtgaccaatttgaattgattcgcgttgaccttgagacgtttcgcaagcgtacatgtcctcgaagggtggacctatttgatgtcttcaatgcagtgctttacgagcttcgtacgggcgctcaatggcgtcagttgccgcatgattttccgaaatggcaaaccgtttacacttactttgccatgtggtcaaaaccattagctaattcggaatattccctgattgacctgcttttaaaaaaattgtcgctcgagagcgattacgaatgggacgatcggtacgaacgtcgttcgtaattcttgatgcgcaaagcgtcaaaaatacggcaacaccccaaaataaagggtatgatggcggcaagaaaatcagtgggattaaacgccaccttgccgttgatattaatggtctcccattcgcgatccacattaccacagctaatgtctccgaacgggacggtgcgatcgctttactcgcgttaaatgaagagcagtttgatcttgttcagcgagtgatggccgatggtggctatacaggcgacaacttcgcccagtcggtccatgcaatcattggtgcagatgtcattatcgccaaacaaagtgatctgaagaacggtcaagtaacgccacagcgctgggtcgtggaacgtagtttcagttggttaaccaactggcgacggcttttgttcaattgcgaacgcaagttaaataccagtaaagtcatggttgctatggcctttatagggatcctgcttgctcgtcaatagagacctcaaacagcttctaagaaatagattagttaaagattactggttaacggacggtttgtcaaccggaatgaaactgattttttaaaaggacgaatttaccatttaggtccactacaattagctgccatcacgttaccggcaagtcactaactcactttttcagaggaaaatggacgcattttggcaatggaatacgctacaatgaagacaatcaagaaaggggctttaatgatgaactataccatctcggccaacaatacgtttccggttgtgcagattgcgctacaacaagatgaaacgatccagatcgaatctggctccatgatctatcacaatggtttggttgaactaagcggccacatgaatagcaatggcaaacgcggactcggcggcctaatgagtgcgattggacgctccatgaccagtggcgagagcttttttatcacaacggcaactggtaaggcggctaatgccgaattggcgattgcgcctggcaaccccggcgttatcaaagaattgacgctcgatgccaatcatcaatatcgcctgaataccggtgcgtttttggcaatggacacgtccgttagttatcacatggtcagccaaaaagtcggcggtgccttatttggagggactggcggattcttcatcatggaaacggatggcaccggtacgatgctggtttcggcttatggcgacatcattccgatcgaacttgatggcagccatgaatatgtcgtggataacagtcatgttgtcgcctgggacagccagctagattacagcatccagccggctagtggtgtcatcggttttactaccggtgaaggtttagtcaatcggttcactggttccgggaccgtctatattcaaacccggaacatcgaggcactggccaacctgattcaaccgttcatccccagcaatgataactaatcactaaggagctctaaacgatgccaactaaaataggccttcactacaacaaaattggggttgggaaaaccatctactttttacatggcatggggttagacggacacagcatggcagctttttatgagccacgtttgaccagcgaagagcggcattttgcccgcctctatccggatttaccgggaatgggaatttcaccggccacgtcagcattgcaatccgctgatgatgtgttggcacaggttcatgctttcattcaggcgaccggcgaagggccatgttatcttgtcggccattcttacggtggctatctagcattaggcctgcttgcccgatttcctaccgagttttccggtgcttttttaaccgctccggttgtactcgcggagaaaacagcacgtacggttgcgccactaaagcatcttattagtgcgccagtgaccagtcagtcaccggaatttaccgactatcaacacatgaatgttgttatcaatccttcaacctggcgacaatatcagaaacttatcttgccagggcttaaaacttttaaccgcgatttctgggttgccatgaagaaccgccatgcttatcgtctgccaattgaatcacgcttaagcagcctgattaagtcaccagttacgcttgtgttaggtgaaaatgacaatgaagttggctatcaggatcaagtggtctttgcccataaaggcgcacacatgaccacaaccgtaatcccaaacgccggtcataatttgatgatcgatgcgcctgaggctgtcatgaccgcgtttcatcagtttctacacaaatagtgccaaaccgctacgcttgattaaccgtcgctattctgcggcggttttttgcgtcctctttatatccgagctgttaactgttcaggcgttaggtggcgtgtggtgcgaaagatgctgtaaaccgattccggtgagcgaaccggcgtttgattgagccagtaaacaattaaatccacaaccccttgactgacaatctcctgagcataatcgctgggcacatcacgatcatcagcaactaactcactaccgccttgccgcaacaactcaacaaccaattgcttcactttcgcggttagttgcgtttgattttcattcaacagtaaaacggccagatcccgttggcgatacaaatacttgaacaactgaaagaaagcatcgcgctcgggtaacgggtttgctgcgtgtttagcttgaagcggtttgggaaaataggcaaaaatgcttttcacatgtccgatcatttcatcttcataatgcgccaataaatcatacttatcgaaatagtgcagataaaaggtgccacgactgataccggccaacttggctaattgttgcacgcttaacttgctaaatccttcctgatgcatcagcgtcataaacgcctgctgaattttcatttctgtttcaagcattttcgtactactagccatcgcgtcaacctccatgaacatactgttaattaccattctcattgaacaacaatttttaccccgaagcaattgacaaatcgtgccaaactgttcacccatttaagcggcgatcatcagcgctttttccgcatgctgccggttaaaagtgcgttcagagactgaacagatggctcagattgtttcttgtctgaccgccttaaggccactatgatcgtgaatgaacagagtgtcaatttgaaaggcggtcttaccatgctaagaagtgaatggcattatctcatgaaacacaaaatgatggtcgttgtcctggtggcaattgcgctcatcccagccatctattgttttatctatctttcgtccatgtgggatacctatggcaagatggatcagttaccggtcgccatcgttgatcatgatcggcctgttacttaccacggaaaaaagattgcgattggccagcagttaaccgccaatttgaccaaatcaaccgcgctagattttcatcatgtttctgcttccactgcgaccaaccggctgcaccggggcacctattacatggtgttgaccatcccgcgtaacttttccaaaaaggcaaccaccctactaacgaccaccccagaaaccatgccgctttactttcggttcaattccggtcagaacttcattgtctctaaaatgaccacaggcgctgcgactgccatcaaatcaaaagtggcgagtcaagttaccaaattatatgctggcattgtgctaacggcactacatcaggccgataccggcatgaccaaggcggctgccggcggccaaacgttgaccaccggcgctcaacaactcacaaccggcaccgcacaacttagcactggcctaaaccgcctcgcaaccgggcttcagcaagcaaccaaaagtcagggacagacgaatcaagcagtggcttccctcaataccggcgtcacccaattaacaactgccgccaccgcactcgcagctggctcgcaacagttacaaaacggcagccaaaccttagccaaccaactgacaatcggcagtcagaagttggcaagtatccaaaccgaagcgactaacgctgctgctttagccgcgcctgtgcgtgaagtcacgtcggatgtcgccaaaatccccaacaacggaaccggcatggcgccttttgccatcgctatcggcctctatgtcggcggaatcgcgctgggcaccatgtacgaaggcttcctgccgcatcgtaagccacgtcatgcactaagttggtgggccagcaaagcttcggtgattggcaccgttggcttattacaggcaggattgcttgatatttccttattggctggtaatcatttgcacgtcagcgatcatggcctattcttcatcgccattcttctcggatcctggttgttcctgtccttgatcttctgtctccgattgctccttggcggtttcggaacatggctggtttcaatcgtcttagtcctccagctagctggctcaggtggtttatatcccacttatttagtggatggtgaaaaactataaaagtactttaataataggatttaccaatagttcggcgtataataagtgcaacccttatttgcccgaaatgcctatgctttgggatttacccttgcacttatcgctgacctatcggaggaattgatcatggtttatcgtcaaaaagcaacgcaactgtcatttgaatcctttggaagcgctctgggaacaccgctcagcccggacaacgagtgggttcaatatgcagaattgatcccatgggccaaacttgaagaggcataccaattacagtttccttcaaaaaccggccgagcagcgaagccatttcgattgctttatggcgcaacgttgatcaagttgaagaaaggcctgaccgaccgccaagttgtcgacgatatccgtgatacaccagcctatcagtacttcatcgggttacccgaatatcgcgctaagaagccatttgaacacacaacgttggtgcactttcgccaacggctttcagccatctcagatttgatccgcaacattactaatgacttcacgcgcgagcggttggaggccgatctacctgaggggacgcatgttttgattagtgatgcgactgccgttccggtcaagatcaagtatccccaagatacaacgctgcttaaccagagtcgtttgaatctcgaacaaatggtcacagatctggcccacgggttaggtgtggaaattccgcggacatacagacgtgaagcaaaaggtaagtggaccgctttttcgaggaaaccgcggcgtcaaaacaaggaacgccgcaaacagcttcaagctcagctacaatacatccgaagagatctgcgatatgtggcggaactgcttgcgcaaggcggtcagctcactgattggcaagcacagcgtctggaagtgattaaacaagtctatgagcagcagctcttcatgtttgagaaccacactcaccatgtcgagaatcgcatcgttagccttcaacagccgtatatccggccaatcgtgcgaggtaaggcaaagcagtccgttgagtttggcgccaagattgactgttccatgttggatggcgtgattgatgtagagcgtttcgacttcaattcatttaacgaaagcactgatcttgaagtaacgcttgaccatgcttttgacctagtgggtgaatatccggatgaggtgctggtcgatactctctatcgcacgcgagataacatcaatctgtgtaagaagctaggcattaaacttaatgggccaaagctgggtcgaaagcccaaacatgtggatccgaaacagcgcaaagccgatgtcagtgcggaaaatcgtcggggtgccattgagcgcaagtttgccttcttgaaaggttcacttgggcttgacttagtgaacaccagaacggctgagtccttggtggtaacggtggatagcgcgattgcattggcaaatatcgacctcctccttaagcttttttctgtaccaatttctattgtggtcgaacagggtggcctgcattatcaaatcaactataaagtgactgaaattcggccagaaaccgcagcctaaatcaccaggcactatttagtcaatggctttgcaaaagcgattaatgaatggctgccgatgacctatctcattgacgctttaagaagcttaattgcaacacatcaagcgattggcaccgacatggcgatcatgatcggcttaatcggactatttaatcttcttatgctcttccgttttcagatcggcttgcatcaaagcttcatcgaaattgatgctactgaagatgcttaacgcgctccccggcgcaaaagcctgcgtgtaaggacctcgaacgcaatggccaaaaccgggccatcacgcccaaggccacttacactccggtctctaaccgcgctggctcgcgcttacgataaacgcgttcgccagcccagaaatctgcgtgtaaggaccttgggcgcaatggccaaagcccggccatcacgcccaaggccacttacactccgatttctaaccgggctggctcacgctcactaaagaaggtgtttgcgatgttaaaaagcaacaattcgctcagtatctcagccttaattgaacaacacggtcatgagaagattcgtcaggcccggcgtatgctggttatgaatctcatcgtctacactgtgattgccgccattgagctatggttcggcgcgaaggatcatgccgttgcgttaaccgccgatggtcaaaataatttgactggcattgtcaccgtctctgctttgattgtcggactatcgtttgccacccgcccttctgatacatttcatcttgaaggtcactggcaatttgagaatcttgccgtttttctagccggcttgggtatgtttcttatcggcctgatcaccatctgggaaggtctgggcgcaactttggccttactatccggacacgccgctgcgccactcaaaggccaagccgctatcatggctgccatttcagcggtgtcaatgctaatcctttgttggttcaaccacctcattggccaacatacacaaagtagttcactcgcggcatcggccaaagattttctcggcgatgccttgacttcaactggcaccatgatcgccattctcggtgcttcctattggcacatccactggattgatccactggcagctgttttgatcgggctattcttgatctggaacggcagccgaattctcagcaccagcgccgaaaagctctccaacgggttcaatcctgccctccgcacccaacttgtggacaagctgcaaactgttagtgggatactcgcggtcagcttcgttgatggtcggtatgctggcagcaatattattgtcgaagccgaaatcgtgctcccagccggtgatagcctcgccaaatcctaccgcatctgcaaaagtgccgagcaagtcctccaaagtgactttccagtgctgtactgttgcattcaggtcaaacccaacttacccaaaaatatgtctagatgatgagctcccaccacacttgccagcgcagagaactgactaacacttaaaaagcacaagccacagacagaatgagttctggctgcagcttgtgcttgtttaggttcaaaatcgactaggcttcgagcttttctttgtttgaatccgccacataatgcggaatctcatcatcaatgaaataaaccttataccaaactaagaaggtataaatcgtccaaactttgcggcgatcattgcgctctttgcggtaagtcttatcgagaatatccaaaattgcgtcttgatcaaagaactctttaacccagtcttgctcaaatgtttcgcgaacctttttataaaaaggttcatcttcaagccactgtttgaccggaaccgggaagccgagtttttcgcgactcgcccattcttctggcaagtgacggttggcagcttcacgcaaggcgtacttagaattgtgcgagttgatcagatatttggttggaataccagccgccactttggcaacttccttatccaaaaacggtacccgcagttccatagagttggccattgacagcttgtcggccttcagcaaaatatccttaggcatgaactggtgaatatcaaggtactgcatcttcttgacttcatcatcgtaatggcgcacctttttgtacgattccgttacgatatcacgaacgctcttactctggcggaagtccggctgcaagatctcatcggcctggccttcatggaaaactaaggcctcaccaatgaagaactcttccgccggggccgtggattcatacagatgcagccgtccgtggaagttcggcatcttcttcaacccatgggcaatgcggtacttcacgccgcgcggtaacttacgcaaaccgtccgcgaagacccgaatcgcatggctgcgggtatgaaagccatagttggcatacccggcaaaaagttcgtccgccccttcaccagacaaaataaccgtcacatctttgtgagccagtcttgtcaggaagtataacggcacgcaggaaggattggaatccggctcgtccaaatgatattgaatcaatgggaagttatccaatgcctctttttccgtcacgatatcactagtgttatctaagcccaatttgtcactgagttctttcgcagcgaccccttcatgatacttcttgttgtcaaaaccgatggagaaagtgtgctctggccgcaacagcgcggtaatatatgacgaatccacccctgaagaaagcaaggagccgacttcaacatcggaaatccggtgggcatcaactgattcggacacactcttgtcaatggcagcaaccgtatcttcaaaactcagattgttcgccttgaagtccatatcccagtacttcttaatcgtgagttcattatccttcaacgtgaagtaatgaccttccggaatgcgataaacgcctttgaagaaagtttcgtccaacgcagagtactggaaggtcaaatacggtttgagcgcttctttgttcagttgcttcttaaacttaggatgtttcaaaaaggccttgatttcactaccgacgatgaacgtgtcgccatcgtggtagtaatacatcggcttaattccaaagaagtcgcgcgcaccaaacatttctttcttgttgtcatcccaaatcaggaaagcaaacatgccgcgaatctttttcaacagttcttcaatgccatactcttcgtaaccatgaagcagcacctcggtgtcggaatgggtcttaaacacatgtccggcagcaatcaaatctttgcgaatgctctgaaaattatagatttccccattaaagataatcgcaacagtaccgtcttcgttcagaatcggctgcgaaccaccctttaagtcaatgatcgacaaccgacgaaatccaagcgcaacatcatcattgatatattcgccactcgaattcggcccccggtgtttgatcatatccatcatgttattaataactggtttcttgttcaaaattgtcttgtccgcaaacgcgatgattccgcacatacagttaaccccttttcgcgtgaatgacgatcattacttgtttcagtataaagatttgacaacgcaagtcaatcaaagagcgtgagccagcccggttagaaaccggagcataagtgtccttgagcgtgatggcccgggcttggccattgcgctcaaggtccttatgtgcaggtttctgggctggcgaacgcgtttcagagcagagcgtgaacaggagcgcttagaaatcggagtgtaagtggcctcagccgcaatggccgggctttggccattgcggctgaggtccttacacgcagatttctgcgactgtgaacgcgtttcagagcaaagcgactacaccctcaaagtcggcaccatcaccttttttatgtggcctccaaataagcacacgacacggttaacgccatttaattatcaatattgattttcttttacccaacacgctaggataagtatcaccatgatttgaaactaagatggaatatgaaaattcaccattgactagcaagatagagataaagagcctgttattaggatcaatcacaggcaatttttcatggatagtttgattgcctctttttaaagcattcttaaatggagtagatatttgacttggaacgtctatcagatagttagaatagtttgccatgctgccagattcaaattgattaagaatgttttttagacggtttccaatggaatcttgtttacaagtatcaccgtaatatatattcaaaagcaattttcaaaaacgctaatttaaaatttaatacattgtagttgtatctaaaattaatctttagtcaactttcttcaacttccgtatttttaatttttttcaaggctttatctataagcttctgtggaacatgctgcctccttaccttttttaattatctgagctgtttcttttttagaattcgccataactgaaaagccattatccttttcagttactttaggaatatatttaggacctggatctttgtctaatattatggtgttaccattcgaatcttttccaagtcttaacacttgtggcatattccacttgcacccttctaactctagaatctctctttttatttcaattgttgcaccaagagcaccatcatagtctgcacaaactgtattcgtagtaaaactattaatgccaatagcttcaggaataacatgttctaagctagattttttccccacccaaaatatacacgtaattttcaaggttaatccccctaaacaagataagcgatatagtttaatcaacaaaatcgattgccatacttttttgcaaaattgataaaacccaaattcgcataaataaatattcttgtctatttgctcactatttttaaacttaatcattttcaaaacttgctttgtaaattctagcggcgcagcaccattagcagtaactaaattatgatcgcgtactgttttttcttgaaagaagtctgatttgttttgatactggtcaaagtctttccacagatattgtgcgttaccagtatgtttgaagttagtaagtaatccatttttagcgagatagtccacggcactacagatcgcacccacgaacttgttattcgttagctaatcttggattagctgttttagtacactgtttttaatttgctatgaatttccaccaatcaatattaatagctcacaattagccggtattttccgatttatagtctactgtggttctaaaaccaccaattgaaactacctcttgcttaatggaagcagttttaacttcctgactaggggcttgatttaatgtacttgaaaggtaagcgtctcccaatcagcatagtcattcaacatcacaaaaactgcttgtttcataataatggagtctctattctattgggattagtatctcacagaatcccaaactgactaatttctgtttatatcgttcaataattggcttattaagcaccttaagttgtttttcgcagataatctggttcaactttttataaaattcattaattgctatttcggtatgaggtattttaaaaatagcgtactttatggaaggtaaaggcctttgcttaatacggttattcttcaaatgttccttattaataattaaacaaacatcatatctacaattcgcatcaggaacattctgcggattatctaaagctatacctagaatagttgatccttcgaatagaccttctgccttaacccattgtttaaaggaatgcattaattttccattttcactaccataagggcccattcgtctaaaataggcaacgtttgtttctttcatatattcaatatgcacttttctgtactccatttttttacttggacgtcctgtgtcattagcataaccccagttaaaatgaaatacactactgatttaaaaatatgtttctaaaacaattgtattccctgtacaatggatcaagtagagaagtgaaagcggtggctatttccgatcggaagtggtgcttatggcgttaaccttcaaagcccgtaattcctaacgaaaggagtagcctaagtgtccgttgcggacgcttacaattagtgctggctttcgatacgtttatcgtagccttgatcgcattaattgttgagctgatcaaaagtcagcaaaaaatggtcaatcctaccaccaccaaaaacggcaaaaaaatagagacccaagttcctacagtcgaacttggatctcctaagttaaggatttgaccgatgcagtcatgttgttacattgactggtactaattgtaaaaccctcttcaataaacctaatactgcgacacctctacaaaaatcttattcacttgtacggaacgacgagtgttgaaatgatgttgccagataacttggcgttgtttggtggttctatgacacacccgattgaacatctatgggaagctcattgtcccgtttggattactgagtcttgttattagcctcatacctccatgtgtgttcatctttagatctcatggaacatgaatctgacgataggtggcgcagatacttactgcaccaacgctctattcgttttactcgtgctttgcgacacacactttcgagccagttcgtttgcttgttactgaacgaaggatcgtgattcttggttcctgcatcgaccttgatgttcttccttaacttcaaataaagtgtatcatgtaagcgctatcttggcaagccctatgacctgcttttttacaaaaaaatttttaaaccgtcaaaaagcaaaccggcgaacccggcttgctgcgccatagccatagagacttaaacgccgacgatcaatgtcaacactgacaacatatccggcatattcgctaggagtaccaaaatgtcgatcaaaccggcgattaaatttagtcgtcaatccgtgatggcgacccatcagtgcactggtattttgtaggctgtaatgaataccattcacctgatagtccgcttccaagtggtagtgtccggcgagatacgcaatgatccgacccgtgttttgggtgaaatcaaaccttaactgtccgccaaattcaggcgttttacctgtattcaacaccccactggcatgcaaattaaatgcacgcaacaactcatggacggcccgaccgttaaactttaaggctggttggcctttttgattcatcgccggcgcgtgactcatgattaacacatcacggttcaacgcgccttttaacgctaaagcaaagtcgcgtaactgcgcaaacgaaaccgctaaagtcttcttgacatcgtaaactttatgtccggcatgtaacggtacatcagccgtatttaaaacgatcacgcgtaatcccggatagtcccgcaccaataagccttcacgcgaaaccgcaacatcaggctgcgcggcatctgtcgcaaatatcagctgacgattaacatccggcaagaagctgcctttgtgaccgggccgcttttcggcgaatttatcattgtcatcgtgattgcctttagtaaccagaaatggcaccgcacctcgccgataatcagccatgatattgcgcaagcgcattttggttagccatggcaattccgagccatcaaccatgtcgccaagatgaacccgcaagtcaagtggcatccgggtgctcaaccactgctgctcacggacatgccaaaatccagtcgggccataataagtcgacgagaatttggctttgtcatgagtatcggtaatcaaggcgaaattcaaggctgaaggcgacaataatggtgtcaccgcatcaataaaatgacccaaatcttttttaacaaaaggacgaattgtcatggcctgcttaacctcctcacacgtacgctttaccgcttagaaattgagccacaccccaagcgccaaaaagactacctgcgctaaagtggtgacgaatagatttttgatggcgttcggaaacgtcagctttttaaccggattagcagcaaatccacgcgcatttttgacgaccagcggcacggtgatcaatgtcagcagcgtcaattttggcaacaggccgagtaataccgaaataatcagcatcaagaagcctgccgtatacaaactataaaagaaaacaatactgcgctgacgtccgagataatggacaattgtgcgccgtttaagcgtctcatcttcatcctgatcagcaatgttgttggccagtaacaacgccgaaatcgcgcattgtgccaacccacttgccagataaaccgacgcaattaatgaccacgaaaagtcaaccacgttaaagacgttgacataaaccgcgatcagaaaaatgacaaaccccatcgtaaatcccgagaagaattccccatacggtgtggcggaaatcggccgcggaccacctgcatagccatagcccaccgcaaagctaaacagtcccatcaccaacaatggccatccggtacggcttaccatccacaagccaagcactgcgctggtgaccatcattaccaccaccatccagccaatcatgcttggattcagatgattgacgccaatgatattggtcttttcgcgaaaatgtagggcttctgtcttttccgaacggcgataatcttgatagttgtcattcgcatcaaccgccatgttaaacaaaagcatggcaacaaagaaaaccaacaattccggaatatgtaacgtatgataatggtaccaggcaaacaacgtccccaacaaaaaggggaaaaccgatgctgttttcgccttaatctcaactaattcaagaaatacagatattgacataacaacctccaacaattgacttttaagaatcaggtacagtagagtaaatatgtctttaggaaagagagaaaatgcatgattcatcccctgtggcaccgattccccatggtctatcaccaactcgaacagattcagcagcggctggaacaggtcgctactttacgcgaaccacaagtgcatacgttgattcagcaacaaatcaatgcaggcggcaagatgttacgaagcgggcttatgcttatgctagcgcgttttggcgaacctgacaacgctgagcttgtgacggctggtgctgcgattgaagcactacacctagccacactggttcacgatgatgtgctggatcatgccgatattcgtcgcggcatgaccacggtttctgccgagtccggaaatcgtgaagccatctatgccggtgatttcctgtttgccatctattttcaattgcttagcgaacaggatcccgaaaccgttgatttaagaaccaacgcccgcatcatgaagcgcatctttatgggtgaagtggatcaaaacggccccagcgcaccgctcattccaaccgtcaatgcttatttaagtgccatcagcggtaaaacagccgctttgtttgcgctggcaacttatacaggcgcaacgattggtcacctttctgccgcccagaaaaaggccgcttaccgatttggccggcagctcggaatggcctttcaaatgattgatgatttacttgattatacccaaactgccaaaacattgaataaaccggcgcttgaggatttaaataatggcattgtcaccttgccgctcatctacgcctatcaaactgtgcctgaccagttgaagcctttaacgaaaacagccgaacaaatcgctgccaatgctgatgaaatcgctgcgattgttcgtaaacacggtcttccacaggcacatcagcttgcgtttacctatacacaccgagcaattacagctttgaacccactgccttcatcgcctaccaaagcagccttgaccaagctcacgcagcagctcttgcagcgaacgcattaactaatttgtgatttctttagcgatcccagcttcaattttggttgcctgtcagtgcaaaaattgttaaagaatcgccgccaacattgcatatttcaagaaatcatgccaaaataataattcatttaatttttaaaaattaacaattagcacaatgtttcacaaacattgtgctttttaagtggtatgatacagatatagcaatagtgaaagagtgatcaaacatggtaaaaatcctctctatcaatgccggcagctcctcacttaaatggaagttgtttgacatgcccagcgaaagacaagtagcagaaggcgcaactgatatcctgcgtcagtcgacggttaaaatcaagtatggtactgatcaggtttatgaaagtaccactccgattcgcaattatcgggaagctgttagtaatttgctcagtcacttgcaatctttaggtctggtgaaccgcctcgatgaaattaccggcatcggtcatcgcgttgttgcaggtggagaactattttccgcacctatcgtcattgacaatcgggtgttggcccaaattcgggcgttgcgggattacgcgccactgcacaatcccgtcgaagccgattgcatcgatattttccgtaagatgatgccgtgggcgcttgaagtggcggtttttgatactgcctttcatcagactatgaaaccggtcaattatctttacagcattccttatgaatattaccaaaaatacggcgttcgtaaatatggcgcacatggcaccagcgttcggtatgtcagtgctcacgcagccaaaatgctaggcaaaccgcttgaatccatgcgtatgattgtcatgcatcttggcgccggctccagcatcacggcgatccaaaatggtaaatccgtggatacgtcaatggggttcacccctgtatccggcgtgacaatgggaacccgcgccggtgatgtggatgtttcattgattgcctacctcatgaaaaagttagacataaccgatgttgatcaaatgattgacattttaaacaccgaatccggattgcgtgggatctccggcattagccacgatgttcgtgatcttgaagccgccgccccgacacatccgcgcgcaaaactagcgctggatattttcgtcaaccgaattatcaaatatatcggtgcttacgcggccttaatgaatggcgttgacgtgcttgtcttcacagccggcatcggcgagcacagtagcaatattcgtgcccgcatcatgcaatcgcttggctatctgggcgcccggattgatcctgagcgtaatttacagattcacgataacgccggcgatattacggcagcggatgcacgcgtcaagaccctcgttatcccgacaaacgaggaattaatgattgtccgggatgttatgtcattaagccaagttgcccaacaagcggaatgaatccgattttgatcttcaacctgccttaacaattgaatcactgctttttgaatgcgccagaagtcattacagcaaatgctgcctgacttctggcgtttttgggttcaaaaaagttgccttatattcacacaaatgatagccgctcaacccccgtaaatcgccgcagctgacaaatcgtcatcaaatttccaaaatgctgcttgcaattccaatagtcgctgtttatactgtgcatatattacatatacagtataaacacacaaaggagatgttcgctatgctcaacgtcaccaaccttaccaagcgttttggaaataccaccgccgttcacgatgtttcttttgcggttcgacccggagaaattctcggacttatcggtcaaaatggtgccggaaagaccacgaccttccgcatgttactgaacttgctgcaaccggatcaaggcacggttacttggaaccagcaaccattggccaaactgagccgcgagacaatcgggtatttacctgaagaacgcggtttgtatcctaaaatgaccatcgcggatcaaatttgtttcttcgctgaacttcacggcatgaaacgtccagcggtcatggcagtccttgatcaatggcttgaccaatttcaagtcaaaggcaagcccaccgacctcgtcaaagatctgtcaaaaggtaatcagcaaaaagttcaactgattgccgcgatgattcatacaccccaatttattattttggatgaacccttttccggtctggatccggttaatgcccatctgctagaagtcgggattcgccggttgcgtgatcaaggcagcgcaattatctattcgagccacgacatgcgcaacgttgaagccatttccgatcggttggtcatgctaaaaaacggtgccgttgtcttatccggcaagcttgacgaaattcgcgaacagtttggtcaaacccgactctatgttcaatcccccttaacccaacaggagctacaggctttccccggcgtgatcacggtgacgccacgttctcgcggcttcttagtcaaactgaccgatccgcaagttggccatgatattttcgccgctgccacacaccaaggctacattcccgagtttagtcaacaagcaccatccttagacgaaatcttccgcatgaaagtagaggcctaatcatggaaaaaatggatgtcatttttcgccaagtcttcatcaaaaaccttaaaagtaaaacctggttgtggattgtcctgggtccgttagtattagcagctatctttggcgcggttttctggttgatgaatcaaaccaatcaaacaacccgaatcggcgtggtttcggacagcccggcattggttcaaacgtttaaaagcagcagcgacaacgatcagcgctatacgcattacgccaccacggctgcagctaaacgagcattggcggccgaaaaacttgatgcagttttgacagtcaccggtcagccgactcaacaggcaagtctcattcagcgaacaaatggacaaagcatcaaccgcacccaactgcaaggcgtgctggctcaagcccacaccaaaaaagttgccagtcaactacagctatcgaccacccaactgcagcaactttttgcgactcccgccttggccactaccagtgtcaaagtagatgatggcaagcttgtcacccgctctgccaaatcccaagcgtccggatcggttgctggtttcatcgtcggtattttgatttacacctttgtcatcagttatgcttcaatgatggcgcaggaaattggtacggaaaaaggatcacggatagaagaatcgattttaactgcgattacgccgcaagctcagttctttggcaaactgcttggcattctggcgttgatggcaacacaaatcattatttatgctgtcgtcggattagccagtctcgtcgccttacgccagctaccgcaaaatcccctgtcaacgcttatcagccatcttgacctgagtagtgtgagtccaaacatgattctgtttagtattgcgttcttctttgtcggcaccttgacctataccgttttggccgccttaactggttcgttggttgcgaatcaggaacagatcggccaggctaccacaccgattgtgatgctgggaatggttggctactttggcgctatcattgttgccaatggcgcctcgcctattcttaatatcgccagttatgtgccatttttatcaaccatgatgatgcccgtacgactgggagcaggccaagtcagtgctgcggccggctggtcagcattcggcattaatgtgatctttttaatcgcgttcacctggctaacggtcaagctttatcagacgaatgtgttaagctattctgatggcgggattttcaaagcgttcaagcgttcgttacaattacaacgtaccgcccgcaagcgtcatccggtcaaatcatgacacgaaatgaggttaaccatgcggatcgtcatctcaaatcaatcgggcaaaccgatttatgaacaaatcgaagaccaggttaaaaccgcgatcctcgccggccagttaaaggcgaatgaacaattgccatctatccgcagtcttgctaaagatttacgtatcagcgtgatcacaacgacccgcgcctatcacgaacttgaagcagccggattcattaccaacgttcagggtaaaggcgcctatgttctgggccaagatagcgctttggtccgggaaaacgcactgcgcgacattgaagcgtccctgaatcaagcaatcgacacggctaaaatggccaaaatcacccccgccgagttgcacactatgttagatacattactgcaagcagaaggagaagccgatcatgacaactgatttactcacagtttcgcacctcaacaaacactatgaggattttcacttggctgacgtcagttttcacctgcctgccggttatattatgggtttcatcggtccaaatggcgcaggtaaaacaacaacgatcaaagcgattctcgacatgcttcaacctgacagtggtgccatcaatttactgggccaaaccaccgttgcagctcgaaaacaggttcgggatcagcttggtgttgttctggatgggatggtttatccagactcatggcaatcaaccgcggtgaatcggtttgtcggtccttttttccctagttgggatgcggtttattttaaacagttatgtcacgattttgcgattcctgaaaaaaccaaatatcgtgatttatcaatgggtaccaaaatcaagctgcaactggccgcggctttagcccatcatccgcagctcttaatcttagatgaacccacgtctggcttggatccgattgcccgtgacgaactcattgccattttgcaggattttatcagcgacgatcaacatagcgttttgatttcaacccacagtattatcgaattggctaaagtggccgattatgtcacttacttgctagcagggaaagtaaccttcactgggccattaagtgacctgcttgatcggtatattatgattaaaggtggcccaaatgagttaaccccgggcattcaagcaacgattatcggattgcaacaaagccgcgtcggattctccggtatttggcctgccgatcaagccgatcaactgcctgacagtattgttcaggaaacagttgatttggaaaccttgatgattgcttttggcaaggggaggcgtgcacatgcgtgatttggtcaaacttgttggcttggacctggctgtatttcatactaatagtaagaagtatttttggtttggtactttgatcagtatcgttttgttgcttctccctttcttgaacggtgacttagcaaccccgcttgcaggcggcattacgggtcttagcattggcttattgatgatgccttttgtcggtgttgatcgccaaggaatggagaatctttacaccatgttaccggtccgccgtactaccattgtcgccggccattatctgttcggtttgatgacagtgggcttaattgacgcgtgcagcatgcttatcattggtctgggttggatggctcgcgttaatcccatccgtgattcacaagctttcgggtggatgctttgttttggtactgcgctcatgctctttcaaattatcttatcgtttccactcatgattggcttggggtttaagcgcgcgcctcttgctgcttattttccacttgccattctcttaattgccatctttcttgaaagaagcttccaagtagacttagatgccctcaagccttggttcggagtaattgtggcaatctttatttcagctttcatcttctcttggtggttgagcaccatgctgtataaaaaacgcgaattctaacccgtaaacaaaaagacgccatttcataatcgagatggcgactttttgtatcttctcaacattgatcagccctgtccgtctttaaacgcaggatataatgtcatccctccgtcaataaatagggtcgtgccggtgacgtaacttgactctgtcgatgccagccaggctgctccggcggcaacatcttccggtttacccagccgtccttggggaatcatggcgacggtttggtcatactgcgccttatcagcaaacttttccgcattaatcggcgtctcaatggcaccggggccgatagcgttgactcgaattctgcggttagcgtattccatcgcaatcgtctccgtgaaaagtttaactgcccctttagctgcagtatagctggcaaacgttggccagggaatctgttcatgaaccgatgtgatgttaataatattacctggctggtgatggtcgagaaaataattcaaagcagcacgggcgcctaaaaagaccccggtttgattaatcgcaatgactttattccagtcatccagagacacttcatgcgtcggtgcttttatttccatacctgcattattgacccagacatcaaggcggccaaattcggactcggctgttttaaccaaactcgctatccccgcttctgtcgaaacatccgcatgaatactgactgcctgaccgccatttttgatcactgtatcggctgtttttcgcgcgccttcgtgatcacctaaataattaatcacaacggccatatgctctttgccaaaccgttctgcaatgcccgcgccaatgcctttggagccaccggtcacgactgcaaccttaccattcagatctcgatacatatccgtcttcctttcatcaattcaggaattcagcttgctggattcacacttcacacaaccgctttgctctagccttaccgaatcttacaccacgccgccgctgcttcaactggaaaaatgtgcaccatttaccacatttaatcacgacttattaggaaccagtttatcgcgacacgttaatggcattgatcctgactcatcaagcataacaaattattcctaagttcgtcacaaaccaagcggcatcgatcacttactttttaaaattttgcgccagaaacaaaaagtagctgtcaatgataattttgcatcacccaaacgacatcaccaacgtcaagctcagtcactaccaccttcatgcatccaaaaacaccacctgattccaccgaatattcggatggatccaaatggtgtcctttttcgtgtgaatttcaactagctaatccatgcgcgccaagatttaagccagatccgtgccatttgaagcaatgacgcgccgataccaatcgaatgactttttcttactgcgtgccaatgttccttcaccatcatcatcaagatcaacgtaaatgaagccatagcgttttgacatctgtccggaagaggcactcaccaagtcgatgcagccccatggtgtgtaacccatcagatcaacaccgtcatgaatcgccgcacccatttgcttgatgtgctgccgcaagtaatcaatccggtaatcatcctgaacttcccccttttcatcaggccgatcaatggcgcctaaaccattttccacaatgaacagtggcttgcgataacgatcgtaaagttggttcaacgcaatgcggaggccgattggatcaatttgccagccccattcactcgccttcaggaacggatttttcagaccgctcaacaaattaccaccaacttctgcatgatgctcctgcgtggtttcaatcaccgctgacatgtagtagctaaacccgatataatcaaccgggtaatgcttcaacagcgccaactcagctgcggaaaattcaagatcctggaacttaacgccgtactcagccatcatggcatcggtataagccggatattcaccgcgcacttgcacatcgccgcagaaaaagttaaatgcctgattctgttgcaaagttgcaagttggttgacaggattggcatcatagctataggtggtcgcatacaacaacatgcacccgatctgcagctgcggatccaattcatgacccatcttaaccgcccaagcactggcgacaaactggttatgccacgcttggaaaatattgcgcttatcgtcggcaccattgcttgcgaccagcccttgactcatgaccggaaaagaaaacgcgctattaatctcgttaaaggtcatccagtatttaacctgtttaaaatatcgcgtcaacacggtctcagcaaaccgtttataaaaagtgatcagttttttatttttttatttttccatccgccatacttggttaccaaatgaagcggcatctcatagtgagaaatcgtcacgatcggttcgatgccatactttaagcactccgcaatcaatgcatcgtaaaatgctaagccagccttgttgggtttttgctcatcgccttctggaaaaatccgcgaccaagcaatggaaaagcggtaacatttgaagcccatctcgctaaataacttaatatcttctttgaaatgatggtaatgatcaatgcccaaatgattcggatagcgatacttgctttcatcaatcgtccaatcaaagtccggttggttcacaatcgcaaaccggtcttttccttgaggcaacacgtcggcaattgataaacccttgccatcttcgtgataagcaccttctagctgattggccgcggttgccccgccccacataaactgttttggaaatttcaagttagtcatcgtccaataccaccttttctatgccagtgtcattaatgcatcgtcgtcagttgcaccatctgatcgggtctcaacctgatactgatcagagttcgtcacaatcatcgtcacagtcggcgcatacccggccgcttgaatcgcttggtagtcaaattcaaccagcggcgtcccaacggtaactttttggccttgttcaattaaagctttgaaatgtttgccttttaggttcactgtatcaatcccaatatggatcagaatttcggcccctttgtcagatgtgataccgattgcgtgccccgttggataaaccaggctcacggtaccggcaaccggagacttgacgacatcttcttctggttcaatcgcaatcccttgacccatcgtacccgaagcaaacacttcatcaggaacgtcactgagggcgaccaatgttccttttaccggcgcggccaaagtttcggcgtgatcagcaaccaccttagccgcagcttgctttttagccggtgcattaatgccgccaaatgcgagcgtcaacccaacgcccagcacaaaggcaaccacatcgccaatcaccgaaacgccaaaccctttgcccaaataagtcggcagtgacaaaatgcttgccagtgcggccacattagcgccagcaccggacatggcgacgataatgccgccaactgcaccggcaacacaggcacagtagaatggctttttcagttttaacgtaatcccataaatcgttggctccgtgatcccgaaaagtgcggtgatcgtactggagcccgccagacttttcatcttggcatcccgcgccttgaggaacacggcaaacgctgctcccgcttgtgccaacacagcaggtagaagaatcggcatcatcggatcggtaccatacagcgcaatgttgttcatcatcaccggaaccaaagcccaatgaacgccgaaaatcacaaacacctgccagaatccgccaagaatcatccctgccaagaccggcacactcttattcaacgacacaatcgcagttgccaagccattgctgagaatcgaactaaccggaccgaccaccagcatggttaacggaacaatcacgactaacagacacaacggcgccaaaatgttccgcacagattcatgccagatcctgttgaaaaatggctccaaaaacttctgcaccacgaccaccagcaaaattggcagcacggttgccgtatagttggcagccaccaccggaatgccgaaaaagtcgatactcggcttgccaaccaacgccacgatgttgggataaaccatcgccgccgcaatcgccatcgcaacaaattgattgactttcaactgtttggcagccgtaaatgccaaggctaacggcagaaaatagaaaatgccatccgccgcggcccaccaaatctgataggccccgcttttcgtcgtcagccaaccaagcaccaccgctagcgataacaggcccttcaggatcccggcaccggccattgcacccaaaaatggggtaaaaacgccggaaataaaggttagcaagccgttgaaagcgcgcttaaaggtcattttttcatgggtcacggttgccggtccttctgtgccatcactcaacgatggttccagtttcacaacttcctgataaacatcgctgacattgttgccaatgaccacctgaaactgtccactagcctccacgacggtgataacgccgtccaaggcttcaactttttctttgggtaccttgtcttgatcctttaacgtaaaacgcaaacgggtggcacaatgccagacctgattgatattttgcttaccgccaaccagtttcaacaactgtttggctaatgctgtttcgcccatttcaaactgcctcctttagtttacgctcagcacctgcagttgcacccgctgctgatgccggctttaacgcgttccccggcgcagaagtctgcgtgtaaggacctcagtcgcaatggccaaaaccgggccatcacgcccaaggccgcttacactccgacttctaaccgcgccggatccacgcttactttctttaacgcgctccccggcgcaggggccggctcgcgctcacataaaaaaagccagaaagacatgacttgtggtgcacacaagtcgtatctttctggttttgcctaattcaatagttacaagcccaattaaaatgtattcgttttcaacatcatcatcttatctgatggattagcgttcgtcaactactttttaaactttgcccctgactcttggctaaacgggcgatgtggagggttagataaatttgttcgttttttgaaatcggtccgggtaatttttgctgcataaacttaaccacatcttccatgcatcggtatgcctgcgtatagtcttgttgcagatgtgccagcaaggcctgatcatatggctcgggtgataccggtgttttcgccgttgaagttgcataaacacgttgaagaaagaacttaagatgaatgaccaagcgttgatactctggcgtcttagcgttcatgttcagtccgagttgatagaaaataattttggtaatgttagccagcatttgcgtgaacgccaccgagttaacgggatgttgttggctcaaatcgttgctgacaaatttcaacgcaataaaacccgcctcatcttccggaagctgttccccgatctgattagcaatttccgtcaacgcccattcacccatgcgaaaagccggctcgtaggcaatctggatctcccacagcaatttgttatgcaggataagctgttcatgcaggcgcgtcacggcaaaatgtatatgatcggctaactcgattaacaaataactgttgaattttgtgtgtaactgaacttcagcttcctgaataatccgcgcggcaatcgttaaatattcatccggcaagctggcaatcgtcgccatggcaatctttagtttggcgtgatcttcaggcacataaactttcatcgaatcctgcagcgttaactggtcgccttttttagcatgaaacccaataccgcgttcgacgacaatgatatcgcgcttatcacgtcgcacgacaacggcattgttattaagaatcgcatcaatgatcatagctagccctcccccaaggcggtcaggtcacggttcaatccgcatccagattcaggctaacaatttttcgagaaaatgacaacgtaaacgacttggcttcaattttcaccgcacttttttcagaaggctaactattcagttgctaagaccacctgatgctctgcaaaccgataaacccgatccgcaaacgctgctgattcaggccggtgcgagatcagaatcacaatgccgtgatagtaagttttaatcgcctctaaaatcagccgttcattttcggtgtctaagttgcttgtcggctcatcgagaaccaacacactgcttggatgcaacaatgcccgtgccaactcgagtcgttgctgctcgccgcttgaaaatggcacgtgactagccgcaacgacggtatccaagccgtgactcatttgctccagtcgcgcccggagtttaacttgatcaagaactgtccaaatctgctgatccgtgatggctgggtcatgcagcgtgagattatcccgcaccgactcggagaagaataccggtgtctgcggcagataattcttttgattgcgtaatgcagtcggcttgatggtcgccaaatcgttaccgtcaatcaaaatctgcccatgactaaccggataccaacccatgatcagcttggccaaggtacttttacctgatccgctcgcgccaacaaaaccaacgatttcaccggcattcaaagtcagcgtgacgtcttttaataccgcttccggccgaatgggataactaaaagcgacatgatctacttgaatttgattaatggtcgtgactgtttgagttgcgttgggcaatgcggcatttaacggctgttcctgtaacagcttgaacaaatttttcgccgccgcaaaaccgtttagcaacgaacccggcagattatttaatgccagtaacggtccaaaagtaagcggaaaaattgcgaatagggcttgttgaatggtcgtgggttgcggccaaccactaagccaaatcatcaacaaccaaccgccaacaatcacaacggttgccgccacatttttcaacaattggctaaactgcgtctgctgaaaggccgttgcttcttggtcaaaaccttcattaccttttgtcatgcgttgcttggcgatccctaattgccgcaccaccgccatgccgcgcactgattccagtaaatattgctgattggcagctttcaaacgatcggctgcctggattttggctgtcagttgccgatgacgcgcatatggcaccaccattccaacggcaacataactaatcagtgcgatgattgcagccagccaatttagctgactataaatgccaactaccaagagcccgtataccaacccgatcgcaaccggaaccaaggtatgcgcgtaaaaaatttccatggcttcaatatcactgccaattagcttgagcgacttaccactagcttgcgtatcaagtttagccggtgccagtttgaccaattggcgataaaccgctccacgtaagtctgccaatacgtgaaacgcaacataatgtccggaatactgctcgccaaagctgcctaagcctaataaaataatggcgatcaatccaggtaacagcaattgtccagcattttgcggatcaaaaagcatcatagcagctaaaaccaacaccacgactttagctaattcagccaccataccaattagaaaactaataaaaatagcgccggtcagatgatgcgtatagcgtaacaggcctctaatcattgggattcacctcgttttccatcatctccgggttgtctaccagttgccgatatgcaggctgtttttgatatagcgtctggtgattggcaaccgttagctgatggtcatgaatgaaccagacttcatcagcctgcgtcattgccttgagatcatgggaaatgaacaaaacaatcttatggcgactcaacttcttaaccgcctgaaggataatcgcctcattggcttcatcaatactcgatgttatttcgtctaataagtaaaccgtcttgtccgccagcaacatccgggcaaacgccaactgttgtcgctgcccaggtgaaagcagccgtccgttttcgcctacttgggtcgcgtaacctttttccagcgatggcacaaactgcatcaatcccaacgatgcgagtttggcttgccattgatcaccgaaacggttgcctaacaataagttctcctgaatcgtgccggaaaaaagatattcgttggcagagacatacccaaacacggccgcttgttgcacattgcttagagccgaaaccgcagtctggtcagccataatggcgccggataaaggtttcaatcgtcccaaaatcgcttggattaacgtacttttgccggttccattttcgccagccaaaccgtaaagcttacccggaaccagggtggcattaatccccgttaccagcggcgcatctgcggcatatccaacgttaacctgatctaaagtaatttggctaagcgggcgattatccgtgattttgacggtgtctggcacctctttagccttggcgatcgtggccaaaatggctgccaatgatgggccatttgatttcaccacatggacaaaataaccgagttgacgagcatttaccatcatcatcgccaatgtaaaccaagtggcaaacgcgcctgccaccggtaattggccagccaccagctgaactgccgtgataaagccgccagcaaaaaccgtcaaataaccaaagccgttaatcacaaacaaggtctgcaattgcgttttcaaaagattcattgtcgcctgccgaaaaaactcgctatcatcggcaaacttctgggcataacgatctgcggcatcatacatcactaaggtggtcatcccgcgtaaatcatccatgaaccggccgcccattttcaaaaatccactgagatgtgccttgttctgtgctgacatgcgtttacctaaaaacatcatggccagaccaattaaaaacacacagccaaacggtaaaagtgccaaccacgagcggtaccaaaacgaaagcccaattaaaaccaaaaacgtcatgcccgcctgcaaaatggttggaaatagcgtgctgtaaaacatatctaaattattgagaccacccaagtcgcgctgaatcaccgcatgatccgcagcagtggttgcaacagcatcattgcgttggtaaagcgcagtaaaatagcgatcccgcagctcccgtttcgcactcatggcccatgcgtggcgatggtgaagttcataacccaccacgtaacccaaccacaccgccattaacaccagtgttgtcacgagcgccgcaacctgatgcccagtacccaaattaagcgcaatcaagatcggtagtaaggttggcaaccaatcaaaaattgcttcaataaccccagcccaacgttgatcacgtccgtatttcagtaatccaaacaaaggcttgcctcttttctcactttgaatatgcagcgtttcaacctaccgctggccctcagcgcaatggcagattgttgttacagtttaccacgggaagtcatcagtactgcagcaatttttagtgcaagccgtcaaaaccgatctgtcagtagtctatccattttcaaaaaagccgatccctcgcacactgatcggccgccaccagcttgtattatgggtgaaccagtccgcctgcatcaccattggaaccatgatttccctgagccggcttaatctcaatgagcaacttatgcggcaaacaaatactctgctggccaatgcgactaatccagccagtatgcaccgcaatctgatcaggcgaattatcttctttgtcccgaatacgttcaccctcaacttcaatgatattgtactgaccttttgccggataaagcgtgaactgctgatggcgggtgtgcgctcccagcttaattcgccgtttgacctgaccattaactgaaattaccgccaccttttgactcgtattcacattggcttcggtcagcgaaaaaatccccgccggaataaagcaggcgataaatagtaacacaacaatgatataatctagcggtcgtacatagcgtttaagccagcgcattcttttcacctcggtttaaagccttcaacatttatcttacacgttatcaagtcgtaagtacggcccactgcctgtcagtgccgcccatcaggattagtccagttattcaggccaactaaaaagccacgaacttccattcgcagctttcttcttattctgaccgcacgattattttcagaacacgactattttgcagcctttgccgccttgataattgccgccaagtaaccggccgtgtcggtgaaagtagcgccagacacaacgtcactggccttcttcttaccttttaagtcactaactgctgtttcaagttcggcaacggtcttccccttagcaaattcatcaatagccgttgaattttcctgccaggtctttgtcgctttgccttttgacttcataatggcagaataagcatcagagtttgcccgcttcgaagccaaaaccgtgcctgccttaatgcccttgccaaaatcggtattcgaattaggaaccgcaccgaagtccttggctggcatatattggaactcatccaagaaaacattggcaattttatcgccttgcatagcaactgtcacgatgccaaacgactgagtcccatgcggcgccgccagaacctgaccttccgtgagattcgtatcagtcgtttgaattccttccgcaaccattccggtcgttgccgcatcataaatcgcttgcagatagccggctgtatcagcaaaggtcgcaccggaaacaacatcgctgaccttcttagtgcccttcacttcagccacagccgcttttagatcactaatcttcttacccttaacaaaattcgtaatcgccgtttcgttttcttcccacgtgtgagttgcctttgcttcctttttcatcaacgctgagtatggtttgctattttccgccttagcaatcaaaatctgaccggacggataattttttccaaagtctttattggaatttggcaccccagtccaatccgaactctttttgacatactggaactcattgattctagcggacacaatcgtatcgccattcagcgtgacattcaccgccgcaaaagactgcttgccgtgtggtgccgcatacaattgccgcatcatcaaagtaccggcagccggaacttttgcattcgcatccgcacccgttttgatcttgactttggcgttgctcgtttggctggtggtgctgctgctcttacttgaactagacccagacccaccgctacatgctactaacccaacactaagtaaaagcgttgccccgatgatcgcaacttttttcatgttgtacccccttgcttgaaatcgcttacatttatatgatgaattttagcacaaggcggctgtgttagtacacgttttttgatgttaaagtcttttagattagcatattaaaccaacccagccataccactcgaatctatcgttttcccctacatttccacacaagtccggtatgccaatttctgctttaggacaatcagcttcgttatcatgaccgaactttcacgaaataaattatatgcatatgctcattaatcgttgtttcccgatctggcagctgctgaaagccgactttacgatacaaatgtaccaatttaggttcttccgcaatcgtgtctacataccatgtttgaatgagcggaaactgttcttcaatcaactgtagtccgagctgagcgtatccctttccttgataagacggcaagattaaaaatggtgaaatacggactgccgaatttttgcgatctgttacaacgcgaatcaggcctatgtgtttatctttaacgattataaagaagaaggcattgttatgccgtttgaacttttttctgtaagctttccaacgattcacagtaggggttggtttcccgatcttgatatttgtcgtaaatggatttgaacgcctgttgatacatgtgacggatttctttgagatcagtgtaaaaggctggggaaaggattagtttcgcttttgacattgctgttgccttcttttgggatttgcatagcatttatggggtgaggtttcactgaagtttttttgatctgacatctacctgagactattcaaactgcatagcaacttttccaagtattcttgaactgattgatctgacatctacctgagacgaggcatgttagacgtcatatttgctgaaacctcttgaactgattgatctgacatctacctgagactctcgacaacaacccgttttggcaccacaagctcttgaactgattgatctgacatctacctgagactgaaataattgttgacacgtgagaacacaggctcttgaactgattgatctgacatctacctgagacactggcatcaatcatcatgaagtatgcgatgctcttgaactgattgatctgacatctacctgagacttagtggcagagaggtaatgatgatcacacgctcttgaactgattgatctgacatctacctgagacgcatatagcttgatattggccgcaagctcggctcttgaactgattgatctgacatctacctgagactttctgtcgggtttgtggaatggcactgtggctcttgaactgattgatctgacatctacctgagacgtctagcccgagaagttccgcggcttttttgctcttgaactgattgatctgacatctacctgagaccataaggtggcagcggccatttgtgtttttgctcttgaactgattgatctgacatctacctgagactttaaatgcgtattttcttttctcaactgtgctcttgaactgattgatctgacatctacctgagaccgcagtcttgcaagccgtaatgctcgatctgctcttgaactgattgatctgacatctacctgagaccccataggcctagctgtcgcccgtaaggcggctcttgaactgattgatctgacatctacctgagacacagccgtcttgatcttgtcagcatcacccgctcttgaactgattgatctgacatctacctgagacggggcttctgcaatctggaatgcccttggagctcttgaactgattgatctgacatctacctgagactagaatactaccttttggcacaatattattgctcttgaactgattgatctgacatctacctgagactcaatcgtcatgccaagcggcatagcacctgctcttgaactgattgatctgacatctacctgagactagtgatcatattcatgcaacacaaacggtgctcttgaactgattaatctgacatctacctgagacttgacaagtcaaagtgctcatacaagtatggctcttgaactgattgatctgacatctacctgagactgaactcatcgcttaccggcaaccagtcatgctcttgaactgattgatctgacatctacctgagacggtggcatcacagaagcaaccgaaacaatcgctcttgaactgattgatctgacatctacctgagacaagtggtaaggtccccaaagattcgatgatgctcttgaactgattgatctgacatctacctgagacagcatcctatatttccatgaatactgatgagctcttgaactgattgatctgacatctacctgagacaagcaatccagaaactcgggatcgtttcttgctcttgaactgattgatctgacatctacctgagaccggtgttttcacacagtctcttaatcaatcagttcacggctatccatgaaatctttgtcaatatagatatactggcacctctcaaaaaactttctacgttcgacatccgaaaattcaatgagaagtaattctaacgatgtttccttaacctgatctaacagcttgttcaaactatcaacatctaaataatgactgatgttggtaaaaatgacaagacgtttctcctcaagtttcgccaaagtcttaattgccgcttcaactttcgagaaaggctccgtgagtacttcttcatcaaaatgaacattacagtatttcatgatttgttcaagttttccaccaggttcgactgtgactggaagttcacttaacaacggctctctcaataagctcattgccagtcgttgtgactgctcaatcaactcaatcagccgccgatcctctatcaattgacttaccttcttgatgatcaagcgttggaataacttgtccaaatccagctctaaaaccgggtcaccaatccataatgatgctttacgcaactcttgaatttgcatttgctcgttgctcaagacaatgccgtcatcgtcattgcgaaaagcctgaaccagatcaagcaaaactttgggtaaccctgtgtctattactgttatgacggagggcttcgtagtgatcagctgaaagggataatacgccaagttcaaatcatcaccgtcctatcagccgagttgcgaatatcctgcttttctgtcccgaccataaaatgcatggactgatactgtgcctctgtgaccatcagtgtttgaacgataccagtcggcggcttaaccgttgctattcgctgctccatataagcagctgactttttagttttgcaaactcgcacataaaccgagtattgaatcatcaaaaagccttcatcaatgagtgctcgccgaaaccttcgataatttcgacgatcttttgaagttgcaaccggtaaatcaaacatgatcattaatcgcatggctcgatacctcatctggaaacttcacctcaattcgacacaccttagctttgccatctaaaaaggccagacaattttcaacatgatcggccactgcattttggagtaaggctttcttaccgttgaacgtaatctctaggtttaacaaatcaatcaggccatatttgacatctggcgtcagctctttaatccgatgctgtgccacccaataatcgactgcgggacgaaaaggctccattaaatccgagccgagattatagggatttgaagcactgtgatgatgcaacccaacctctgtcagatgccctgtgctgacaattgctcgattagtggtcgaaagtagcactgaatacccgtaattcaatgccgcattagttgcacagatgtcggatcgagaaaaatcatcgccaaacatcaacttaaaatagcgacgtgcggcactagcctctcgattagatacatcatttatttcaagtgcgtcgagatcatccagtagtccttgagcatcatgtccacaaagctttgccacttgcgcctgattactgatcttagctgcaacaatttttgtccaaacggtttcgattaaatcgagtggccaattaacttgtaagcgaacctgttcagcccgccgtcgatcagaatacaaattcttagtttcggttacgggttgcccgtcccgcccagagaaaataactttcgcgttcgcgtccgctaaagctgcaatcgcatcagctgaaatcaacgcacgtgtcgttgtaaaaataacttgattcagatcatctattggcatcgtatacacttcaccatttgtttggacaacaagcgaatgctgcttcgttgtcactttacaatgctgcgtgatgatgaacgagcgccatcccataaaatcaccccttgtaatcgcttccctaatatgctttaatacagttgttgagacgacatcctcaacaacttgaattgattgatctgacatctacgagttgagatcaaacaaagcttcagctgagtttcaatttctgagcccatgttgggccatacatatgccacccgagtgcaaatcgggtggctttttttgctttaaaaatagtttacaagtcagctagcggtattcgacgtttgaacagaccgcttggagattgataaacaatttgtgtatctttatcaagcttaatgccgctcccaacttgaagaagacccagatctgtcttaatacctaaattttttacattacttcgggtgccattagcttgtaacccaattaaaatctgtcttaaagtctcagttttcccgattttattgccatcagtatttattggtaatttttcaaaacgttcgatagcatcagatagtttcgctcgaaattgattaatgtcataaagcttaaagaacttctctacctgatcgatgatggccttatagacttgtaaagcatcgtggttcatttgggttttctcatactttatggaaaacagtttttttagcaatttttgattttcacgagataaccacagttcttgataattacgataataggtgtctgagttcaccataaacaggccatacttagcattctgaaataatgtccccatcccaaagcgagggatgacaattttaaaggaattagctgacggcttccaatttttccttctcttagcaagctgctttactacaatttcgtttaatagctgtttccctttttcacgtgattttaaattggctgatgcaatttttgaagcattttgtgctgagatcttaataacttgataagcagttgtatcggcttctgctactcgaacaagagcattataactccctgattcttgagtataacccccataaacctgagtcggatatccctgcttcttaggaatcaattgcttacttccgccacgttctttcgaatccttggcagcataaattgtttgcttgaacaaatcagccgtctcaaaataaacctcatgcgttatcagcatccgcttgaagttgtatatccgatccaactctcggatatcacgttctttatcccaaacaatctcgccggtatctttagcgataatattcttcttagcatgtgtcagtgcaccaatgaagttgaattcgcggaacttcttaacatcaacttttgcaaattcgccatatgtgaaaaatggtgccaatttcggataccgcttaagcagatacgtgccaattcgcgctgctaagaaggcatcaaatgcatgatgataatggttcacgtcacgattctttggaaaatctagttcttcgcgtaattggtgggataagccagctttgactgcaatgatcttggtgttcggatattgggcagcggcaatctgttcggttaatttaatgatctggcgtgtttcaaccaactgacgcgcgacaaatcctttcgcaaacttatcgatctcatcagggcgcagcatcaagtttctaagtttacgtccactgattaaaccggcttcgtgccacttacgccaagttgccttcatcttgccagcaaacaaggttgaagcaaacacgttgttcttttcgcggttgatggttgcgttaacgagcacgcggttatctaaagagtcatccttgatcagcgattgtggcaatatgtgatcgatgtcataatggctgagttgatcgatattcaacggtgcgccggtataaatatcgcgcccgccttgcatgaagtaaaggactagccgatcggtaaagctggccttgtctgcaatcttatcctccaattcaccgcggacagcactatcaatcagctcttgggcggcgttggcataaactgtttgaatttgcttttgccgtgactgagtgcgcttgccagcagtacctgttccgtctgccgtttcaataaacagccaacttggatcttgaccatttgctgcatgcttgatgtcctcaacaacccgtaacacttggcgcaaagcttttttattgcttggcgaagtatacgcatcattgatcacatcttcaatgtcgtctgtcttcagcttgtcttgattcaactccgtcatcgtttcttttaatgtttcatcggccaaaatttgcatcaagttatgattcgaaagcattaattcctgaattacggtgtggccattgcctagtttcaacccatctaaaagctttcgcgagaactgaccccagccacgataccggatgccacttaattcattgattttctttggatccaaccattcaatttctgccaacttggtctcaaaaattgtgtgatcttcaaaaaccgtcgaccacgtaataatattttcgatatcaagtaattttgtcgggtcatcaattgcctcatgtaagatttctttcaattgatgataagttgaaagcgaacttaagaaacgtttttcatctgccagtccgcgaatctccggtcgtcgggcaaaatctccatgagcaaccaaattatcagcaacttgtttaatggtcacactgctatgccgctcgaacacctcacggatcaagcgttgtttttggtccgttccaagacattcattgttaatgcggacattgttcagctcattcagaacttcatacttttgatacaacagactttgtttgggtaagacatcttcgccaattaaataagtgtcggtcgtcttcatgcgttgaataaacgtgtttgccgaagcttcacgatcaaccttctcatcaaaattgtaaggagtaatattgcctgaaggatctttacggaccatccatgcgaagacattttctcctgactcagcctgttgttttggcgtgatcagcggtcctacatagtaagggatatggaaatttaacaactcgtctaattgataaggcattttccaccgatgcgcttctactggatttggtgcggctagccagtcgtagtattttgattgattggcaataatctggtcgagttcacgttgttgcagttgtatcggaatcgcaccattggccttagttcgttgtttgagcatgaagtttgcctgtcccattcgattcaacagctgctccgacacttcatttgggtgtgcggttacttctttggttaaggctttaacaaagtcttccctcaaaaaaggcttagcatcatcgccattaatatatcgatcataaagaccccgaattgttttagctaattcgtgatcatttagtttcttgaggtaggttttaaacagctcaagatcttctttatgttgcccatagtcagcaacttttgcctgggataagctcatccccgctggcacaatgccatttagcaatcgtgctcgataaagttcttgaatttgttcaaatatttccgttccttgatcggtcatggaagtttcgatgttactccacttgtcgtccagctgccccatcgagaattgccaatttgacgcatcagcttcatctacttctgtacctaaagcaagattgaacttggtttttagccctgtgatcgctttggcaaactctgtcagcacttgtttgcgtttcttgacgatttctttctcaccatcactgcttaataacaagttcaccaaggccttctgggtatcgctcggcgtcgcttgttcatctagcaattttgccttgaagtcatcagcctttgccaaatcaaaagttaactcaagatcgggataaacttgcgcatatgcctctgtcaaggcaggaaaaatatcttctaaatcgactttatccgtattaaagtctttagcagcacccggcgtcaaaaaatgcccgcgacttttcaaaatatgatggattgccaagaaaatctcacgcggatcggctttatgcgtatgcgtcatcaaatgcagacgcaagtgatacatactcggatagtcctcgtaaaattcagcatccgttcgatcattaaacagacgcttttcatacttaaacctgtccttgtctttgggcgaaatttcggaatacttttgccgcaaaaagaaatccgggtcaatttttgtaatatgcggggcaaagaaatcgcgtaaaaagcttaaccgccaccgagttcgactcaaacgccgccgagtcgtccgacttccccgccgatcagcggctgattgcccctctctaaatagccgtgcaccgatggccgtttctcctttcagccgcaagaggtgactatttgcatccacaaccgcaaacccaatcgaattggatccaatgtcaagcccaattccatatggttgatttaattttgtcatgttaactcctccgatcctttgacataagttcagtatgaagggtgctgcaatcgttttcaacaatttgtactatcgcgaggctttctaaacgcatttttggcttcgaatgtttcaattgacttttaagagtgtcctttaaggtcaaatcattttcaaggctatctgctgcttcagatttgacttaataaggcaaaataaaagcagctcgatcactatccaaaaatagtgtctaagctgcttttcaaatgcaccagccgtggcatgcctttactccagcactacctcaaccctgcatccaatgcataaagattttgataccgtttattctgttcagctaaatgttgcggcgagtcattcatcgttaaccgcccgtcttccaggaaaatgacacgatcggtttgactgacgccttgaagatgatgggttacccatagaatcgttttaccttttaaaaccgtgaacatagtatccaacaaggcttgttctgtaatcggatctaatccgacagtcggctcgtctagcaaaacaatcggggcatcctgcaacagtatccgtgctagtgacaaacgctgccgctccccaccggaaaagccaaagcctgcttcttcaacgctgctgttcataccgttgggcaactgagcaaccagttgatccagtttaaccgctttcaacgctgccgcaacagtttcatcgccggcatcttcatttcccaaacgcacgttattcacaatcgatgtattgaagagaaaggggctttgatcaaggaccgcaaacaaattcgtgcggtgattctggtagtcgagtacatcttgtccgtcaatgagtacgtggccatttgtcggggttaaatcacctagcaccaattgcaagagcgtggttttccccatcccgctggggccaagaatggcaattttttctcctgcctggatcgtcaaatcaatgttcgtgatcagttcgggatcagacggcgtataccgaaaactgacatcatttaattcaattttattgaaggtagtcggtactgactgctgttgtggcaactcgcgcgtaaccgggtgtagatcgtttaggtgacggatggcatcccgataagtcggccattcaccaaccccttgggcgattcccgaaaacgcctggtctagcgggaagacaaccaagacaaacgcgccaacccaattagccattgactgattgccggtccattccaaattggtccaaatcaacatactaacggcgattaaagcaaacaaaagctggccgataaaatcgcgcccccactgaaatcgcttggatttggcggtagaggcagcaagttttttgggtgctgccagactttgcttcatgaaatcttgatcgcggtgggtaatcacccaatcagacaaacccaacactgaatcggttaacgacacataggcatcatgattcagccgtttttgctctgctttacgaaaacgttcaacgaccaaaccccaccatggaagaatcagaatctggaagagcaacagcagcaatatccacaaggcaaatccccagttaaaccagcccaataatagcgttgcaatgaccgttagaccggcaccgacaaccgtgggaaaaatcattcgcagatagaggttttggatatgtccgatatcgtccgccaataagccgagaatatcgccagtctgatgatgttcggagacaaatgccgcgtcggtttccaagactttatataattttcgccgcatgtgactggtgatccgcaacacccaattatgactggtcaaccgttcagcatattgaaaaactggccggccaaccccgaatgcccgggtcagcaccactgtgacgtaaattgcagcaaacagtggcttggtcgcacttttatcaattagaaatccagaggtgaacatcagcgcaccggcaaagacaaaagtcataatgcccagaatcaatgaccaaaacaacagccaccgatagcgcttgagatcaggccggatccaatgttcatttttcaaccaatgcattgaattcacctcgcatttcatggaccaacgcctgatacggcttagagtgggcggctaattcagtcggggttccttccgcaacaatcttgcccccgtcaaccacgatgacccggtccatttggttcaaccagtgcaaccggtgcgtggcaaagataaccagccgattggcaaaaagcgggactaaggtttcttttaacgcggcttcggtttcaatatccagatgtgcggtcggttcatcgaatagccaaatagaacgatttgtgtcgattaacgtccgggcaagggcaattcgttgcgcctgaccaccggagatgccacggccgccttcaccgattcgcgttgcataaccatctggcaacgaattgatccaagtcgtcaaaccagccgattctgcggcatcccgcactgcctgatcagaagcatccggccgataaaaccgaatattagccgcaatcgtatctgcaaatagataaggatcttgcggaatatagctcaggtgatcctgccaggccgtctgcgtcatatggggaattttggtcccgcgcaccgtgatatcggcagcttgtggctgtaaaaatccgccaattaaattcagtaacgttgattttcctgatccactcgcgccaataatggcaattttttccggtccagtaaaggttaaattagcatcctgaatgcccgctcgcttgtcagcataagtaaaatcaagatgctgcatgctgagcgtatcttgcggctgccatcccttaaacgctggtagcacgtgcgtatccgttggcagcggctggtcaatcaccttccagatcgccgtcatggcattcttaccgttcaaagtggcatggtaatccgttccgaaatcacgaatcggcataaaatattcaggagccagaatcagcgctaccatcgccggatacagcggaatcgtcccatccattagcttaatgcccagaaaaaccgccacgactgcgattgataaagtggtgaaaaaatctaacgcaaaggtggaaagcatggcaattcgcaaaacgcccatcgtctgcttgcgataatcttcagagacttcatagacgttgttggcatactcgcgactgatacccatcagctgcagtgtttttaaccctcgcagtgaatcaataaaatgattgctcatcttttgaaatccggcgtactgactttccgacttatcacgcgccgccaaacccaggatgaccatgaacaagataatgattggaaacataatcagcaacgtgaatccggtcaaccagttttcataccaaatataagccaccaaaatccacggaataatgctcatatttaagatcttatttaaaataagttcgatataattttcagcttcgggaatgccgtcaagtgccatcgtgactaaattaccagtaccttctttagcaaccgctgccggaccaagcgcaaaaagatgtcgcaacaactgcgcttgcagccaggcagcacttttcatcgcaaacttggcggcgatacggtttcgtacccacacgatcaactggcggaccgtaaaagccgcggcaaacaagccaagcggcagccataaaccagctaaactttgacgattccaagaatgaacaatcccttcagcgagatattttccttggagtaaaataacaaaagcttgcacgagtgcaaacccggcaagcattgtcattgtttttcgcattcccgaaaggcgcaacagcgtcttatcgatcattcgctaaccgcccctttggcttgaatgcgtttgtggaagacaacatagctccaaatgaagtaggccaaggcaattggcaaaagaataactgccacaatggtcataatggtcagtgtcaatgggctggcgctggcatccttagcgagaatcgacatggccgcattttgaccaatcatcacccgcgggaataaaccgttgaagatgacgccgacaacgccgaccaaaccaagggcgctgccaatgaatgacaagacttcattatcttttaaaaccccgatatgggctgcgaccgttgaaccaacgatgacaaccagaatcagcaacgtgctaatcggacgttccttgaagaaatcggtcatgaagaatagtaagacagcgaaaacaacttcgccggcataaagcagataatacaacttgctattccagtcacgtgctcgcttccgcaagtcgcctgtggtcttcaagcaaatgaagttcagtccatgcatcaacatcatcagggtcactgcaacgccgccgacaatcgtcaatagattaatctgattgcccaacgtcgggaacacatccccgtttttggtaatcggcagcggttgaatgatcgcggtgaaaatcatgcccaaaataaacggcggaatcaaactgccacacgccaacgcccaacgccaaatgttgcgcccggttttggtttcagcatgtgcggcaaattcaaaggaaaccccgcgaacaatcagaccgaacaaaacaaggaagaacatgatataaaagccagagaacaggcttgcataccacatcggataggaagcaaacatcgcaccgccagccgtgatgagccacacttcattaccatcccagtgcgggccaatggttgctaccaactgatcttcttcatcgctattgtgggccaggagcttagttgacatcccgacaccaaagtcaaacccttcaaggacgaagaacccactgaacaggacgaacaataaaaagaaccataaaatctgtaaccagctcattttgcgaacgcctccttagcaaacggatcgctgttgaccccataatcggtgttcaaatcgccatctggtccattcttcaaaacgcgatgtgaatagtaaatcatcacgccacctaataaggtaaagatcaagaagtagcaaatgttggtaaacagcaattgaccggccgtcgtggttggcgaaaccgcatcggcaatcgtgtacaatccataaacaacccacggataacgacctaattcggtaatgaaccagccagcggtattaatgataaacggcagccacagagcaaaaccgagaatgtacaataaccaccgctgatctagcaacgtatccttcttcttacgactgaaccacaggcctaagacacccagcaagaagagcaaaacgccgccaccagccatgacccggaagctccaaaatagggtcttgaccggcacataataattcttatctttgccatacttggcttcaagttctttattagcagtctccatgcctttaacggaaccgttcatcttatgataggataacaagctcagtaaatatggcacttcaatgttgccgctagttgtgtgatctttggtgttgattaactcaaccaatgtccaaggtgccggatcgctggtgtctttgtaaatcccttcagttgccgcaaacttcatcggttgatccttaatgatgaattgcgtctgcaagtcaccaaagccaatcgcacaagcagatgcaatggtcccgacaaccaagccgaccttaagggacttcttgtaaaagtcgacgtgatcttttttaagcaagcgccatgctgccatgcccgcaaccgcaaaaccggctgtggtaaaggcaccaaagatgacgtgtggaaattcaacccacagttgcggattggtgatcaccgcaccaaagtcaaccaatttgacccgaccagttgtttgactgatcgcaaaaccggtgggatgttgcatgaaagcatttgcggaaagaatccaaattgctgataacgtggtacccaaccaagtcatccaaataaagatagcatgtacagctggcttgaagcggtcccaggtaaacatccacaacccgatgaaagtcgattccatgaagaatgccaacaaggcttcaatcgccagtggcactccgaaaatatcccccatgaatcgtgaataatttgaccagttcatgccaaattgaaattcctgaataataccggtaacgaccccgacagcaaagctcagcaagaaaatcttgccccagaacttggccatttttttatatgtctcatcctttttgcgtacatacatcgtttccatgatggcagccacaagacccataccaattgaaaacggtacgaaaaagaaatggaaaacggtcgtcatcgcaaactgaaaacgagctagcgataatacgtccattgccattagcatatgtttctcctcctttaatagattgattacaatctaagtataccccgatatttattttttaaaaaccaaaaacccaaaaaaccagatggaaatcatgcttcttaggatatttcatttcacaagattgttatgatattctccgacgtcaataatcgcaaccgctttccgggaagtcgatttcctatcttttcacagcggagaaaacaatcgcatctatttgtgaaaaaacgtttacggtcgaatcacttcatgaattaatggcaactttttcggagcagttgtgccgatatgataagcttggcgcaccaactctacaatcgcatccacatgttgatcgttagtgtgcagcatgaccagcgtatcgcctttagtcaccggcgttcccagttttttgtgtagaactaagccgactgccaagtccaacttgtctcctttttgagcgcgaccaccacccagttgcatggccgccacgcctagggcattcgtatcaatcgcagtgacaataccgctttgctcagctttaaccggaattcgatatgctgcttgcggtaacttccgcggatcatcaaccaccgccggatcaccgccttgagcttgaatgagctgtttaaacgcgttcaaagctcggccatcacgcaaggcatcttctgctagcccggtggcaatttccagacttggtgcttttttgcctaagaccaacatctgtgcggctaatgcaaccgttaagtcgtggacatcccgtggtccgcgattttttaaaatagcaattgattcggcgatttccaagctgttaccgattgtaatgcccagcggttgattcatatcagttagcaaggcaacacttttgacgccggcagactgactgatgctaaccaaggctttagctaaagcacgcgcatcttctgaagtcttcataaacgcaccattgccaactttgacatcgaaaaccaaggcatcggtcccactcgccagtttcttactcataatcgagcccgcaattaatggtatcgattccactgtcccggtcacatcgcgcaatgcataaattcgccgatccgctggggcaacatcgcgactggcactcacaatggcttggtggagtgtttggacttggcatttgaattgggcttcagtttcgttaacattaaagcccggaatactttccagcttatccagtgttccgccggtatggccaaggccacggcctgaaatcatgggtacgggaacacccagagaagccactaaaggtgccagcggaatactgattttatcacccacgcccccagtactgtgcttgtcaaccttgatgccgggaatatcgcttaaatcaaggacgtcaccggaatgcaacattgcaaacgcaaaatgatcgcgttcagccgcactcataccgttaaaatagactgccatcaagaacgcactcatttggtaatccgggattttttccgcggtgtactgctgaatcatccaggttaattcatcatcggtcaattccccgtgatcgcgtttttttgtaatcaagtcgaccatgcgcatttttatcacccttcactcggttgttatcactattgtaacgccctacttgctgcctatgttaaactcaaatcaatctattcattcataaaggagaacatcatggattttgctaccttacatacgctgggtaaaacggaattacattgccatctggacgggtctctgtccttaaattgcattcgtcaactagcccaaaaaatcaatcaaccgttgcctgccgatgataacgccttacgcaagctggtccaggctccggaaaattctgaaaatctggctgattacctaaaaacattcgactttatcgcaccccttttgcaaaccaaggaggcgctgcagatggcggcctttgatgttgtcgcgcaggctgcccgcgaaaatgtccgctatatcgaaatccgatttgccccggtactttcgactgccggcgatttaacattgagtcaagccaccgaggcggttatcgcaggtttacatcaggctatggcccaattcgatattattgccaaagccttagtttgcggcatgcgccaattgccaaacgcagacaatgcagccatgtttaccgccaatgctcctttagtcggtgataccttggttggcggcgattttgccggtaacgaagccgactatccgactaaagtttgtgcacctgccattgaaacggcgcaacgacttggcgtcccgttaactttccacgctggtgaatgccactgcccgcaaaatattgccgaggcgattcgcttgggtattccgcgaatcggccacgccaccgcttgttttgaccaacctgaactgattcagacaatcgtgaaaacccatacaacgatcgaactctgtctcaccagcaacttgcaaaccaaagccgcacggtcactggcagaatttccttatcaagccctcaaaaaagccggggccgccatcacgattaatacggataatcgtactgtctccaacaccaccctgacccacgagtatgaacggtatcaagcatattttgataccaccaccgctgactttctaacttttaacctcaatgccgtaaatgcagctttcatccccgaaaccaccaagcaaacattacgtatgcgcttaaaacaagattacgcaccttacctgtaaactcacccgcttaagtccacactccatcagcattattgcgtttcgagctgcaagtgttatcgaggcttcatttttcttaacgtccttaacctttgcttagggaaaaaaccacacgtttatcattatttatccccaaattcatcccgactgattcgcgataaagccacatggacaagctatgctggttctatcaacaaatgaaaggatgattcttatgttgattaaccagacagatttcatcgcaacccaattacagcaaattgtttaccctaatatcaccgccatcactgaaaccggcgcgtcaatcacgattcaaactaaccaaaaacagcgcgatgaccctgctttttggcagagcatcagcgctatcctaaaagcccatctttgggttccggtttctaaaaaatatcatgaactcaccgatcatgactggttagcatcgccagcataaaatttatgcttgatgcgtggcaaaagcattggcagctaaaataagcgtcaaaactgcatcaggtgacaatgcggcactgacagttttaatgtgcccgctggttgcaaccgcaccgattacttcaagcccatacttcacaatattgagatcgcgttgaggtgcataaccaccgtcaaaaaccggttcatggttatatgtaaagtttaaatgatcatctttaatcgaaccatcaacgtgattcaccataatccgatcatgtgccgccgttaacggtgcctgatcatcgggcagattgagtttgtgatccgattcagtggtgtaataatcagcctgtttcatgtgcaagtatttttcagccggtttcttaagtacctttaaataatccacaatggcaaaaaccttcgtgggatccagctgggtggtcttagccatgagctcatcattatgggcctcaagccagtctgctaaattactgatactaaactgatccatgttgtgcctccatattcatcgcagattcttacgccagtatagcatggacatcgggtttgatgtgcatgattgttataaacttgtgacactttttggttctataatgatgttaaggggatgagcatcatgccgacgaatcagacaccatatccgattattgactatttgggtcgtccaatccaactgcagttatttgtcacctatcgtctgcgcgtcaaaaacggctacattctcgcattacgccgcaaccagcaccaacaagcacttcccaaccttctcgttaaacacgcaagttaagcttgattttgttgggacatgctgcatcgcaattgcgacaagctttgatttgacgagcataggttcaagtttccacctgagaaacaaacaaagaaaaggacaaatgaattttttgcgagccaagcgctatcaagggttcgttcatttgtccttctttttttgcctaaaaataggttgcgcattagccacttagtcggaacgatcctcaagcttaggtccgcgtggggtcatgagtgccatcatcgccacggttaaaataatgatcatcccacccagtatctcagccacacctagatgcatatgcaaaaaaatgaccgacaccaaggttgcccccagcggctcaaacgcgtctaacaaggtcgcggctgtcggtgaaataaactgtaggctggccaaatagaccgaataagcaacgatcgtcccaaagatgacaataaaccagtaaccggcccaccctgcttgatccaagtgcggaatttgtttccagaaaggatcgaaaatatcaactaataagccacccagtaattgagcccaagctgtcacgacaataggcgaatgccgcttcagtaatcccgccggcaataatgtatacgccgctgcggctaaggcggccatcaccccccagaaaaaagcagacggcgaaatagccaaatgtgttaaccgtccctttgtcaccactagcatggtaccaagcatcgccatggcaatcgtgaacaaatcaattcggcgcggtttttcacgtaatcgtaacgccaaaaaaaccaaaacgataatcggtgatagatattgcaaaattgtcgcagtcgctgcgttagccactgcaactgctttaaagtagatatattgcatcccgatcatgccaaacaatacaaacaagatcagctgtatcgcatcacgccgattatgccacggtgacataatggcagcgcgatctttccaaacagctaacgtcatcaaaacaacgccggcaatgatcattttagagctaatcagccaggaaactttaatgccttcatcaaataaagcttcactcactggaccggatattccccataaacttgaaccaaggatggccagaaaaatcccccataagcggatgcgtttcaacgctcttgcccctttttgcgctgattggatcagtcttgcatcacaacatgatcatcaattaatcctgcgccttgcaaataattatacacgattaccgggccaacgaaggcaaacccgttctttttcaaatccttagcaattttcaccgataatgcgcttctggttgggatctcagccaatgatttaggtcgattgacaagtggtttgccatccacaaatgcccataaatagtcattcaagctcccatatgccgcttgaattcgcaaaatagcccgtgcattcgtgatcgttgcttcaagtttcatgcgattgcgaataatgtcggtgcgttgtaataaggcatcaatgtccggctcatccatcgcagccacttttttgatatcaaactgatgaaacgcatcgttaaaagcggctcgcttatgcaggaccaattcccagttcagaccagcctgaaaaatttctaacgatagtaactcgaatagcttttggtcatcatgaaccggaacgccccactcatggtcatgataagcacgcaattccggtgacattttggccaaccagtccgtgtattgcttacgcgcctgatacttccgcaatgccgcctctgttttgacctgctcagcgcgatcatgtgcatttgtcattttaggattcctccaagtttttatcgttgttaacgatacattacgccgtcagttgcgagaatgccagttaacgtacttcggaagatgattgtgttgcgtttggggctgtggtagcttggaggaattcttttttcggcaagtggcggcgttattctctgttttctataacgcgctcgcagtcgcagcaatttgcgtgtaaggacctctaacctaaatgggcaaagctcggccattttaggccagatggcccttatgttctggcttacgcccataacgcgctccccggcgcagaagtctgcgtgtaaggaccttaagcgcaatggccaagtgcgggccatcacgcttaaggccacttacactccgacttctaaacgcgccggctcgcgcttaccaaaaaagagtccgcaaccttcgctgccgactcttcatcgataaaacgcttattttgttttgacaatcagaacatcacatggagccgtgcggttaacgtattctgtcaccgaaccgactaatacgcgctcaactgcattcaaaccggttgcgccgatcacgatcaagtcgttgtgatgatcgtggggaaagtcggttgcgataactgtcttagggtttccaaaccggatatggatgtccacatctgtcaggccggtctgctttgcctgatccttcaagttctctaaatattcctgtgcgtcctgtgtcagctgataaactgcatcacctgagatcatgccgccgtaactgccgataaattgtttggtatccagcacatttaacacatccaaatgtgcttgattggccgatgcaactttaactgccttgttgaaagccaattcagcttccttcgatccgtctacaggcaccagcaagcgatcatattcttgatccattccgctcacatcctaactttctaattaacttaagcatagaacggtgaggaaacgaatacaagaaataaatttgcacttttacatggtaatctatcttcacaccatgtaaaatatatgccagtaacatccttgaagcattaacacacaacttgcagaatggctatcattatttattaaaatatgctttacttttgcggttttatgattgatttaatgcgtaatgatgctatattaaagtgagtaagctgaattcttaatttttaaaaatttggcgttcaaaaagaaaagaagcgtggtgaaattaatgattacaaatggtgttggcagtgttttacggcaaatccgtaaaagtcgtggcgaatcaattgtagaagttgcaaaggcaacccatacttccccggcaagctttaccaagtgggaaaatgatcaaacaattccaagtgaacgcagtattcgtaaacttgcggaatactatcaaaccgacccactggaattgctcggtgttgcataccctgataagtatgcgaaacagcaagaacaggaaaaagcagctgcagaaggctcaacgatccgcattgaagatctcatcggaaacaattccgttttgacctacaacggctcgccgctttcttcaggaaccaagtcactcgtcgcagcattcattgctggtcttattatttcacagcctgaatagttgttcgaagtgatgaaggagtcgtctgaaaacggctctttttttgtgagcgcgagccggcgcggttagaagtcggagtgtaagcggccttagccgtgatggccggtctttggccattgcggctaaggtccttacacgcagacttctgcgccggggagcgcgttatgggagtaagctggaacataagtggcgtgaggcgtgatggctgggctttggccattgcgcctcaggtccttacacgcagacttctgcgccggggagcgcgttatcgtcacgaaaaactattcagccgttgctggtcaccatccatttcgcgtatactaaagtcaaacgttttcacgatggaggaattaaatttggaaccatttgttcttaatatcaaaaacggcctcaactttcgcgatcttggtgggtacaagacgaaatcaggtcaagtgattaaatcacgtaaaattattcgctctgccagattaagcgaactgtcagatgacgacctgcaatatctggcagactatggcctgacaaccgatatcgattttcggtctccggaagaacaagcagccgaacctgaccgttatcccgaaaacacgacttatcatttcgtcccagttttcccaacagatgaaaccaaaagcagcgaacaagccgatgctctacaaaaaagtttttcacgcgatccccacgctggctttgaaaatatggtcaaaacttatgccgatattgtcaaaatgccttccgctcaaaaagcttatcggcaattctttgacatccttttaagtcatcaggaaaatgacggtgcggttttatttcactgtacggctggtaaagatcgcaccggcatgggcgccgtttatttgctgtcagcattaggcgttgacggccacaccattcgccaagactatctggcaaccaacgatcttattcagccaatggtcgagaaaaatcttgctgccgctcgcaaacgcggtgcaaccgatgctttgcttgccaacattcgcgatctcggcacagtctccggtgcatttcttgatagcgccttagccaccatcgatgctgaatatggcaacatgcacaattacctgaaggaagccttgcaattaaccgacgccgaaaagcgtgatttacgcgaactttatcttcagtaattagcgccaaaatcgtcatattctgttcacattttagcggtactttaacatcgtcgtgaaaagcgatgttcacctcctgcccattatcctgcactttccgaagttaaatcagggaagtgcgtaatgtaaaagcgctgttcggcctgaccgcatggcgctttttgtctattaaaatgactgtatcataatgcgttcaccgacgcaggaatctacagtatggcgattttttgcgttcgtcaggtcatttagctaaaataatggcaaacaccattgttaggggtggcgctcatggatcttaaagctacgattaagcagcacgccaaagatctgggtattgacaaaatcggatttacgacagccgataactttgctgcattaaaaccaagccttttagcacaaaaagctgccggccacacaactggcttcgaacaccagaatctggacgagcggctctatccggataaaattttcgaccaaccgcaaagtattatcgccattgcgctggcttatccctcgaaaattcatgaccgaccaccgcgaaccggtcccaaacgtgggcgctttgcccgtgctagctggggaattgattatcacacggttctcgaccggaaaatggcagcactcattcgctttattaaaaaaaccgccaagtcacagactgatatccgctttaaacccatggtcgataccggcgaattaattgatgtggcagttgcccaacgagcagggctgggttttatcggtaaaaatggtttattaattacacccgagttcggttcctatgtctatttaggcgaaatcataaccaatattaaatttgcccctgatgaacccatgtcatgtcaatgcggcacatgcacccgctgcatcgacttttgtccaccacatgctttactcggcgacggtcgaatgaacggacaacgttgcttatcttatcagacacagacaaaggggtttatggacccggaatttcggccaatgattcgcaatgttttatacggctgtgatatttgtcagcaagtgtgcccgttcaacaaaggcaaggattttcacgttcatcctgaaatggagcctgacccggatactgtcatgccggaattgatcccgatgctgacgctaagcaataaaggattcaaaaaccgattcgggaagcttgccggcgcctggcggggaaaaaagcccttgcaacgtaatgcgatcattgctcttgtcaatctccacgatcgcagtgccgtccctcatttgcttgaagtgatcgataccgatccccgccccatgattcgcgcgactgccgcatgggctgtaagcgagcttgccgcaaccccaaatgctgagttgacaacattcctggagaaagcgcaagcaaaagaaaccacagctttggcgcaggcagaatttcaaaaagcacttgagcgaatcgcgcaacgttgagcatgctataatagaaaataaagatgagaggtgcctattttgaaattatatcaaggacttacccaagtacaggtcaatgaagaaatggccgatgatgcgccagacttcaagatcacaaccgatctagttaagccgctgcattacgcgccatcggaactctatcattacttagacgctgttttgaaaccaggtagtcggcacgatcaaaacaaccttaaatatgtcacagatgccgccttcattggtgagaattttgacttcaattcggtgccttttaccgctaaattgaaagattttgaggccaagatggcatttgcccgaaatctggtcagtgatcttaaccgccacgttgccgtcaatattaatacccaagaccttacgtttgagcttttgtttgtcgattaatgacgtcatatcgaccagtcattcttcccgttttgattggcattcgcccatcgtcaagaataatcctaaaaataccgcaacccgatcacatgaaacgccgatcaggttgcggtattttttaattgattgatgaccaaattcagttctggcgcaacgccggaataacagcggtcagttgctgaacaactaacacggtcagtgccattttaagcaagtcgcctggaatataaatcagaacgcttaaaatggcaggcacaaatccgatacttgtcgtgaccgttagccataatgcgcccaaaagttctgtcagcaaaacgccgccaaacgtcatgccgattgcttttgtgagccagaaatcccgtttcaggaaatgcgtgatgcccacgtacgctagcggcgtcagcaaccagccatacataaagccggctgtcggtcccataaagacagcaataccaccgcgtcctccagtcaacactggcaatcctaacgcagccaacgccagcaacatgccgatcgtaatggtcgccggacgcgtcggtaataacatggcgaccaacatgacacccatattctgtaaaacgattggtacacccaagaatccaacggtaattggtggggcaaatgccaacccgattaatacagctaataataaccccatccgtgtcaacgtctttgtatgcatgacgccacccttcctgcttttgtatttcgttaagcataccatgttttgtttacaattgatcaaaaaattcgttcatggcctgtctctttagtgttctttttaatctggttaatttaaactgacgaaccatcgtgccatctcgctcaagaaccaccgcttaattgcatcagcgcaaacacaacatgacgcggtacccggcgcagaagtcggctcgcgcccaaataaaaaatcgcggacattatcgtcatccgcgattaaggcctgcccaggctggattcgaaccagcgaccctttgattaacagtcaagcattctaccactgaactactgggcaataagtatgtatagtatattctcatgtttcttagagaaatgcaatacttttgtttgaatttccgacattttttcagattcctcttagacaaggcgctgacaggtgacgcacttgctttgaattttgagttagcatcgtgatccctcctaccagctatctcgtcacacatcgttcatctttttcctctataatgaacgtgaaaggttgtgaacctatggaaacgccatatcctaatatgcaagataaccccaacctgccagttgaatcaggcgatcatcaaccgatttggcaggcactcatcaagaaaatgccaccgttgactgacttgcgcgtccttgtcattcattgtggcgatggctggttttgccgttatgctttgaaccacggtgcgacagctgttcttgggattgacaccgataccgaagccattcaaaatgcgcgtgcagctgcgagttctgatcggctccgctaccgaatcatgcccgatcggtggttgaaattgctgacgggtccctacgatttgattgttggcgcattcgaccaatcgccagcggaattaaaagcgatcactcaggttcttagtgctctgctgaatgccaaaggacagttagtggctgccgttgcaccgccaaaacaaccaactggtgatcagttagcggttgaagaactgatcagctcacaattggtcattaatcgttggtaccaggttaccgacaaacggctggctgaaaccgcacaactttatctactactgagttcacgggtacattaagattatctttctaaagcaacccacgtaaaaagcacgcgttagcaattcccaatgctagggaattgacgcgtgctttttaaactgattttaactgattaaagtttgccgacgcttagttgatcacttcaacggttgcagaaagcactccggctgatggaatggcactatttggcattgcaacgtcaagctggcgcgggttgctatatgcaaatgagccagtatcattaacggttcgttctaacacttgtccgttagacatggtgattcgcagcttagtacctttagggaagacgctcaggtttgcagccacaccttcgtaacccatgttgctacctaaaacagacgggtcatagaaactaattttaaaagtgcccttattagttgatgtttgggtcgtctgggttgctggtgcttgctgttgttgaacagcagcctgagatgcagctgcctgctgctgtgcttgttgctgagcagcggcttgctgttgtgcctgttgttgagccgcagcctgttgctgagcttgttgttgcgcctgctgttgagcagcagcctgagccgcgctggaagcagcagcgttggatgccgcaacactggaagctgcagcgcttgatgcagcggcgctagaggcagccgcattagaagctgcagcactttgagcagcagcatcggatgcagcctgattattatctgtggatgtttgcgcaacctgttccgcagtcgaggttgtctgagttggcgcagcagtggcatcagccttcttggtcaatgatgataattgctgcaaggtgttgatgctcaaataacgttctggaacccaaccatggtcagatgtttcgtaccagatttctgcgtaaacttttttactattaataaatttaaggtgttcaccggttgctacataacgcttaacttgctgtcccacagtcggtgaggtccaaacggttgttgcaccgccattataagtgacatcagcttcagtcttatcactggctggtgcgctgacggtggtgtcagtatctttcgttgccgcgttaacgtgacctggttttgacaaggcaacggcagataaagcaacggctgagaataatactgtacttaagagctttttcatgttcgagttcctcctgaatttgtgtggtgacttaactaactgtcgcttagtatagtcagtgagtattacgaacatgtattcggcgtgttgcgtttaggttaagttctatgacaaaagattacattagattacagctttaacataacagtcggcacaatcgccctcatttagtctgtgttatccagccttcaatccgcaaacagatcactatttaaccgctacaaagccacctggtttcgtatttgtttacagctcggcaacatgcttcatcattgtcgatcatttaaacagccgttctaaaatagccgtcaaaacctgatgtcccggcttcaacagtgcttcgttgaccggcgcttgcggtttatcagctgccgcaccaatcgcagcaatcattgcaggcgtgacttccaaatgaaattgcaagcccacaatccgctcatgataagcaaagccttgcagtgcgtgctcattttcatacagtatctgactgccgggtaatcgactcatcgcttcgccgtgccaatggaaaacattcaataacgtcccatccgttccttttactgtcccgacgccttcctcaggtttcggcatgcgatacacattggcaccgagcgctttggtaatttgctgtgctccaaggcagatacctaaaacaggccggttaagtttgttcagactgcgaatcaaaatccgttcagcagcaagccaatcgagatcatcattcacactcatcggcccgccaagcacaatcaacccatcaatatcagctggatttaactgggcaattggatcgccttggtccggtcgataggtgactgtttcaatcccctgatctgcggcccattctttaatcaccccgagatcttcggcatctgcatgttgcatgactgtaagcttcatccgcccatcacctctcctttattgttcatcttcaccttttagcaccgcggcaaacgcctttattgtcgtcatcccaggatcataaactgcaaaataaacccgtttaaaggcaccggcgaattcaggcatcaacaacgtgtcgcgaaaaatcttggcaaccggtttgacgggattcccaaaaacaccggtaccaaaagcacccaaaatgatctgatcaaccgcatgcattttaaaagcgcgcaacgtttggagaaccttaaacgcaatatcatgcatggcggtttcgttgtctaagtgtggatctacccgacgatcaggggcagctactgtgacgatatcaacatatttattcggtaatcgccgaccttgatcgtcaaacacctggcgcacatgttcggcataaatcagtttggaactaaagagcccgcgattggcctgttgacaattgacatcatagtaatcggccatatgttgcttcatgccgggcaccaggaaagttcctttggcaatcgattcttcttgggctcgggcgccaaacatcacaccaccgcctggatgaatcggactagcaaaattcatcaccccaattttgcctgtcaattcactcataagctgaaaaacatccacattccgaatagcaatttgcggcgaagtagaaccttgtgccggcgtttgcggtaatggttggctgatcagttccgtctttggcatttccggattcgctttaaaaactttcatcgtttcccaatacatcttaacctgttccatcttaatcttgctcctattcaaaataagcgtgatcaaacgcgctcagcactcggcgtatacgcgctttatggtgtggtcactcacgttttgacatgacaacacagattcttacgcgcagataaccacgctgacagacgctttatatcaaatgctgccatctaatcaagccgccgcaactaccccaaaataatttctgaccgatctcagcataacatagaagcaatcaactcatgaattatcgttcatccggccaattcaatgttaaaattaagtttgtaagtaacatgaaatgaggaatggaatacatggaaagtggccaaatcgtccccaatttattggtgatgctcgtcacctttttcttcgcggcattttttgtcgcctgtgaatttgcattggttcaaagtcgtccgagtgccttggaagatatgattgacaaaggcacaggccgcaaagcgaaaatcgagcgcgccttgcgaatggtccacaacttgaatgaatatttgtccacaacccaagtcggcgtttcgctggcaggtattattttagggtggattggtgaaaccaccgttgaattcctgctggtcgatttgttcgggttgacgcatttaagcttgcctaatggtagtttacatgcggtaggtgcagttttaggggtcattattttaacttatttggaagtggtgcttaccgaaattgtgccgaaaaacatttcgattgactatccaattaaaactttaatgttagttgtcacccctttgcattatttccacattttgttcttccccttcgtctggttactgaatgtcagtgcgaccgccattgtcaaaatgatgggcatgaagccggctgatgaaggtaacgaggctttttcgcaagccgaaattttgagtcttagtaaaaacgccgtaacatcaggcgatatggaacaaaacgatgtcatctacatgcagcgggcattcgagttaaacgacaagaccgccaaagatatcatggttgatcgcaccagcttgtttgtgattgatattaataccaccgttaaagaagccttacgtgattatttaacccaaggctatagtcgcttcccagtcgttgcaaatggcgataaggacaaaattttaggctatgtctacatctatgatctggttaaacaaggtcaggtagatccgtccgtcaaggtttccaaactcttgcgctccatcattaatgtaccggaagtaacgccgattcataacatcttagcccagatgatcaagaagcaaacgcctatcgttgtcgttgtggatgaatacggcggcaccagcggtattgtgacagataaagatatttatgaagaacttttcggcactgttaaagatgaaattgacgatgtgtctgatgaatatattcgcaaaaccgacaatcctaaagttttccgagtcagcggcaagaccacactttgggactttgagcgctatttccacaccgacattaaagcgttcaccgactccgaaatcattaccatagccggcttcatcatggaaacacatccggatctaaagttacatgacaaggtcaaaatcgatcactttaactttacggttgccgatttctcccgcggttttgccaactggtttgatgtgactgaagacccaaagccggttaagcaaaccgttgccgaagaggttaaggaagccaagagccagcgtcaagactaatgttgtcacgtcatctgcttttgttggtgaagtttttagctcaagacaaaaatatgcggccttattaaaacaatcaagacccatcatttcaaaataatagcgtaccatttctcgacttttgcaagaaatggtacgctttttgactctttcgtattagtaacgttaactttaacgatttcagcgcccgctacctccacgccactgcctcacgcctcatcattcggtggctacttgccccagataaactgcaacatcgcgcggtcaacggcgacattgtgttcatgcaagcggctgtgttgggcatgcggtccggtcactgctaacgtttgatacttcgttagccctcgcaacaaatagcctagactcaaagccgaattaacgcttacgaccgtatctgtgtcactgccgtcttgaacattaccataaatattcaaaacggatttagctcggaagtgttcacggctttgcaaaagtcgcgcgtactcgggtcgaattaaactaggccgcccatcagctgccaattgcagttcatggggtttgtcattccatcccagtaaaccatcgtacgggccggcaatcacaactaccttttccagttctaccggtgtttgtgccatcgcggcggcaatcacggcataagcgcccatactatggccaaccgcatttaaccgggtaacgccatagcgctgatgcaacatagttagaattttggccagccactgactatcgacttcttcgccagccgtattgttttgaaaaatcacctgaataatgggtgcagctgtggcatgcaagtctccttgcacatttaattggccatttggactgacggtcacgaccatgcttcgtttggccacccccgcagcctccgccgattctataagttggttagtggaaaacgcggtcccccgataaccatgaacaaatatagtcggtgtcgtgtcggcttcgactaattgaccgcttggggccaagccaatgattagaaccgccacaactagcagtattcgtttaattaaacgcatataatcctccaccttgccagcgttcgcgcacatagcggcccgcgtaagcaaggaaaagaggaatcgtcacaccagcagcaactaaaacaagtaaattcggatcgcccaacttttccagcacatagccgaccgccttgtgcccatacattatgggtagtgtactacgaccaatgcgatctagccagtctccaagcacggttccggttaatgttttcgcaccggcaaataaaccgccgcagataataaccggcacaaagctagcaagtaatggatccgttagatggtgcgacttcatgtaaagcaagaagtcgatttgaccgcgcgactgggcaacaaataaaccggcaaaaacaccaagcgcaactagcataaaccatggttgcgtgacaatatggcgagcgtaatgaaataaccaccagcccacaaacatgtaaggcaatgcaaccaatactaaatcaagattgccgggaatcggaaatcccaaaacagtttcagcgttagggtaactaaaccctaaccagaacaatccggccattaaaattgcttcgtgccagacttttggcaaatacccgcgcaataagctaaacagcaagctactgaacgcatataccgtcacaaaccaaaaaactgacaagtagccattcaattcggtcccaccataaattaaccgtcgcaaataatcaacggtaaacgctggggtgcgctgttcaataataaagttcaacaagattaaaccgacgccgtaaccaaagtattgtttcaataatggccaaaaacgtcgcgctagaaaagcttttaaggttggcagcgttgtcggcttaacaaaaaaaccgccaatcatgaaaaacaacggcatgtgccaccaatacagactttcataaaaggttgtgttgcgcggatagaaatgtcccagcacaaccgcaatgattccgaggcccttggcaacatcaatccattcaattcgctgatgcgatgatcggactttcacgtttttaaacgcccctttcgttcgactaacttacttttagcctaacaaggtgagtggggtatttctttgatccctttttaaagattttgtgaaggccatttacccaaaattgtcagtttacgtgctagactagattataatgtttttagaaaggacacgatattgttgacaacaactgatgttaatggtcatccttacaatcgtttgctgcttgtcattacgctactgatcgggacctttacgacttttttgactcaaacgattctgacgactgcctacccgaccttaatggcggattttcacattagcgccagcgcggttcaatggttgacgaccggcttcatgctgattatggggattatgattcctgtttcggcttggctgctggataaattcaacgttaaacatctttatttaaccgctatgacgattttctttttggggtcgctgctatgttggctcgccaatgattttcaaatgttgctgcttgggcgactcattcaggcaatcggcgttgggatgtcgatgccaactttccagaccgtcatgttcaccattttcccacctgaaaaacgcggtagtgccatggggttggccggcattgtgatcgggttggcgccggcaattggcccgacgctttccggttggattctgctgcatcacacctggcgcgcattgtttgcggtcattatgcctatcgctgccggtgttgttcttctggcgatttacagcatgcgtcaggtgctgcctacctcacatcccaaaatcgatgtgccgtccattattgcctcaacgttaggttttggtggcttattgtatggcttttcaacggttggtgacgctggctggacagactcacaggtactcatcagtcttgcgattgggatcgtttttgtggctcttttttgctggcggcagttgcatctcaaaaccccgctgttggagttacgggtttttaaatcgaaaacctttactttgagtgtcattttgaccgctgttgctttcatgtccatggttggcgtggaaatggtgctgccgatgtacattcaaacgattcgcggcgaaagtgcttttcactctggaatgatcctttttccaggcgccattatgatggggatcatgagtccgattactggccggatttttgataaaatcggagctaagcgtttggccgttgccggtttatttctcttagtcgccggtacgctgccattgatgactgtcaccgcaacaacaccactgatttacatcacggccatttatacggtgcggatgtttggtatcaccatggtaacgatgcccgtcactactgccggtatgaatgcactgccaacccatctcatcaaccacggcactgcggttaacaatacgattcggcaggtcgcggcttcaatcggcaccgccatcttggtttcggttttatccgtcgtcacaaaaggggccacgccctcggctagcgggaaagtcctggatccaattgactacaccaacgcgatgcatcaagcaactcttgccggctatcgtgctgcttttgcagtttcgttggtcatggccgctttagggttagttctgagtttctttttgaataacgatgccatggatcggaggcacccatcatgattattctgctgttgattattggcgccgttgccttcttttggacgatggtattgatgaaacccaaccggcgtcgacccttggcaatcgctgtgagcgccttgctaattatgataccggttgtacttttgagtttgaatgatttgtatcacatcggctttacgattgacgaaaccactgaattgcaaccgctagcacccatgaatgaccagttacaaattcaaagccaccccatcggcacggctaagaaacacatggcctatcaatatcgtatttcgggtgatgcaacgattcataccgttaaaccaagtactaccgtcaaaaccaaactgacacacggtacgattccgcaagtcgccgtgactgcgcagaaactccagtacaccaatattttcaccgctattatgttcgccggatccggtgaacaaggcaaaaccattggcaagatttacacgttcactttaccgagtaattggcaggttgtgagtttttaaagtatctatatccgtaaaaagccgtctaaaaagccgtccctagatttctctaagggcggctttttataacctctgaatttccatacggttgaataaaagcgcaaacgccttacgccaacaacattcgatacaacgtactgatcggcaaacccatgacgttgtaaaaatcaccattgatcgccttaaccagtaaagctccggcgtcttgaatgccataagcacccgccttgtcttgataggcgtcttcttgtaaatacgactcaacttcggcttcatcaagcggccaaaaagtgacatctgtggccacgacttgctgccgaatcgtgccattgtccagacgcacccacaagcccgtatagacttgatgggtttggccgccgagtgcagtgatcatttgcttggcttctgcacgactatgcggtttacccagtaactttccttgaaaagccaccatcgtatcggccgcaataattgttgcccccggatagctcggtactaacgattctcctttggctttggccagactctggacatactccggtggtggcaaaatcggcaacgcccgttcgttaattgctgcaggatgactttcgaatgcaggaataatacgcttgagtaatgcttggcgccgtggtgaatgactcgccagaataatcatgcctgcatttccccgctttcatgactgtcttgaatccgcttgaacattttctccagatcggtgttggaaaagtggaccagaaccggccggccatgcggacaattgaatggattttcgcattgtggcagtttctgcaataacgcccgtgcctgctgatcgtctaaatgatgattggctttgatggcccgcttacagctcatcatgatcgccgtcttctcccgaaaagccgcgacagagatcttgccgtcacgcaaaacccaatcaaccatctctttgatcgtgtcttcttcctgaccggctttgaaccacgtcggatgatgctcgaccacaaaactattttggccaaaatcctctagatacaagccgaccgcttccaacacatcccgatgcgtgcggatattgatcgcatcggccgcggagtaatccagcacgatgggaaccagtaaatgttgctgatcgttgctgacttcaccaattgcctggcgataaaactcataattaacccgttcttgggccgcatgttgatccaaaatatacaagccgtccccagcttccgccagcagataggtcccgtgaacttgggcaaggtaggttaaatcgggaaaacgttcagtcggctccggtcgcttcaaatccgaagctgcggtatcctccaccaaggcaggcgcaacattggcgtctaacgtttgataacgctgatcccaagcagccaagcgctgtggctcatcaaaaattggccgatcatctaagtcgttgatggttaaatcgactgctgcttctgtctgcgctgctggttgagaagtcggcgtattgccagtgttagtgtcggcgttttcgcgcacttcagcaccttgattcggcactgctgtcgttttaggactgattttattgagggtcagttccagttgatcaagatcatagcgctcgcgtttaggcaaattatccatggcatcgggaatcagattttccttggctaagcgcgcacgaatggcctcactgagcaagtggctgagctgatcttctttacttaaccgcacctcggctttggttgggtgcacgttgacatccaccaaagcggcatccatctgaattgaaatcacgcccataggatagcgcccgaccatgagtttggagccatagccggcaatcacggctttcgtcaactgaaagttcttgatatagcggccattgacgaccaagctcagataattacgcgacgcacgcgtggtttcaggcaaactggtcaagccactcaccttaaaatcaagatcctcggcctgaaagtcgaccattgaccgggcgaccggcaaaccgtaaatgccggccaatgtctggcgtagatcaccttgaccggctgtccgcaccatcatattgccgtcatggctgaccgtaaacgcaatcttagggttagccaatgccaaccgactgacaatatcaacaatcttgccaagttcggtctgttgcgacttcatatatttcagccgtgccggggtgttaaaaaacagatcgctcacttcgacatcggttccgcgacgatgcgccgctgtcgtttgactttctacctgtccgcctttgacatgaattttagcgccaatcccggcatcggtagcggtcgttagcgtcacatcggcaaccgctgcaatacttgccagcgcctccccgcgaaatcccagtgaatgaacattaaatagatcacgcgtggtcagaattttactcgtcgcatgacgcaagaaagctgtcgccacatcgtcagggtcaatgccgatcccgttgtcgctgacatgaatggtttgcaaaccagccgctgacaccttcacgtcaatttgggtggcttgggcatcaatactattttccaccaattctttcaccacgctggccggccgttcaataacttccccagcagcaatttggttacttaaagtggcagatagttggtgaatttttggcataaaatcacttcttctttaaatgcttttgcaggtcaaaaattaaattcatcgcatccatcggcgttgcatccatcaaatcgaacttagcaagtttggctaaaatcggactattcttgggtgcaggtttaggttcctcaaacagtgataactgctgatcctcgacttggctggtagctgccgggacggttttttccggagttgccgcttcgagttgtttcaaaatagtatccgcacggctcaataagtcagctggcaaaccggctaatttggcaacgtgaatcccgtaacttttatcagccggacccggcatcatcttatgcagaaacaccagattgccgtgttcttcaactgccccgacatggacatttttcagctttgccaatgaatccgataaactggtcaattcgtgataatgcgttgaaaaaagtgtcttggcatggacatgatcgtgcaaatattcgataatcgcctgagccaatgccatcccatcatacgttgccgtgccgcgaccgatttcgtcaaacaggattaaactcgatgcggttgcatgactcaaagccgcatttgcttccaacatctcgaccataaaggtactttcgccatttgctaagtcatcggcagcgccaatgcgggtgaagatttgatcaaaaatcggcaaatccgccgtgtcagccgggacaaacgatcctgcttgagccatgatgacaatcaatgccagctgccgcatataggtgcttttcccggacatgtttggacccgtgatcagcagcatatccgtatcccggtccatgatgacatcgttaggaatataactgtcctgccccaaaacatgttcaaccaccggatgccggccgcctttgacgttaatgtcatgggtcccggcatgcatcgttggccgaacataatggttattctcggcaacggtcgcaaaactttgcagcacatctaacgccgaaatttgagcggctaaatgctgcagccgtttaatctgagccttgactttttcccgaatatcctggaaaaggtcatactcaagcgcggttgaactttcctgcgcctctaaaatcagcgtttctttttctttaagttccggcgtaataaagcgttcggcgttagtcagcgtttgtttgcgttcatagcgaccttctggcaccttatccaggtttgacttggtcacttcaataaagtagccgaaaaccttattgtaacggattctaagattgtgaatgcccgtcgctttccgctctgaagcttcaagttctgctatccactgctttgaattcttcatggcatcgcggtaagcatctagcttttcattgtaaccgcgcagaattaagccgccatccgtcacggaaatcggtggctccggctcgattgaccgccgaatgagtccggccacgtcactaaccgggtctatcttaccgcgaagttctttaaaactgccatcgtcaagcttgctcaaaacatcctgaatcgccgggacttgatccagcgaggtttgcaactgaatcaaatcgcgcccgttaacggttccaaaggccacccgtcctgctaaccgctcaagatcatacacctttgtcaaccgctcttgcagctcactccgctcaaaaaagtgttccagcaaatcctgcacctgattttggcgcacactgatggcatcaatgtccaacaatggccgctccagccactgcttcaataagcgcccgcccattgcggttttggtcgcatccaataatgacaacagcgtatcacctttgcgtccggtacgactattttgtaggatatcaagattgctgcgtgcatcctgatccatttccaaatacgcggacggttgataggcgactgctttttgaatatgtgccagactgcgcttttgggtgttcaacaaatacgccatcaacatctgcaccaccgcggcttcggcaggatcagttaaatcttgggaaacataactgccttcactggtcggcttcgtgtcttgctgcactgatagcagccgctcccctttttttagcatcgcggcatcttcgtcgttcaggtcttctggcaccacaatctctttggtggccaacgcacttaattcattttgtaaggcgaacttgcttttcaggtccgtgactttcagttcgccagtggacacatccccgtaagcaaacgcatacccggctgcgtgcggcaaaactgctgtgatatagttattggtcttcgccgcaccggccttaatatcgatattcgtgccaggcgtgattaattgaatgaccgcacgcttaaccataccaaccgcttttttaggatcttccatctgttcacagattgctaccttatagccatgatcgatcaaaatatcgacatagctttgcacggcgtgatgcggcacccctgccattggaatcggatcatccgcgcttttattccgcgccgtcaaggtcagctcaagtaactgcgcccccttgatcgcatcatcattaaacagctcatagaaatcaccaatccgataaaataaaaatgcatccggatactgcgccttaatcgcattatattgttgcatcatcggcgtatcgctggttttttgcggcacaaaattcaccctttatcctttgactttctctgacgttctattattcatattttaccagttccgtcaatcccacagtttaaaaagtaagtgtcaacttcttctcggttctaatctaattaagtgatttccgagactccgagctggctccgcggtggtgaaggctggcgaccgcgcagctagagtggtgggcacgactttgaacccgcaaagtgctgtattaaagctcggccttggtctaaagcggagaaaggcactccgcttaagaccaatttcacagctgagcccatcgccgctccgccagctcttgctttctatgtcaatattcatcacaacgctgctggaatcgtctaaactgagaagcacctttatttgccatacacgtactccaagagaaacgctaatgcctaaaatccggccagattcaaccaatccagccggcagcttaccgaaacttatttcttcaaatgataactgtacgtcgcaataatcacattttcccggctagcaaaagcagcccgtaagcggaaattggtttggttgtggagaatgttctgccactttttgcgcgggacgaactgtggaatgagcaccgtggtcgtgaaattacgcttagctgcattgcgggctacgatgtccacaaaccgaatcgtaggcgcttcaatcgagcgatatgacgaatggatgtctacaaagcgaacatccggaaagtctgcccgaaactcgctttgggtctccttttccttgttaggattctcatccatcgacacatgcatcgcaatgacataatcgccaatcgactgggcataattcaacgctgctcgggtaacccgcgtcacattgccgacaaggacgataacggtgctaccgtcatagtcatgctcttcaacatcggccggcaaccgtaactgcgccgccactttgtcgtagtgatcccgaatcttgtagaacaagaagatggcaagcggcatgacgatgaagaacggccaaatatcaaacaagcgataagcaaagagaatgactaaaatggcaaaggaaattaaggctccggagaagttggcgactgttttgcctatccagcctttaccacgattgcggaaccagtgaatgatcatgccggtttgcgacagcgtaaacggaatgaacaccccgacagcatacaacggaattaatcgctccgtggacccctggaaaatcgtgatcaatgccgctgaccccagcgccagtgtcaggatcccattggaataacccaagcgatccccacgatccaggtacatatgcggcatgaacttatctttggctaaattaaaggccagcactggaaacgcagaaaagcccgtattcgcagcgaccgccaaaatcagcgccgttgcaaactgaacgacatagtacatgattccagtaccgccaaatgtttctttggccacctgcgacaataccgtcacttttgccattggcaccaaaccataccagtagtttaaaaatgtgatcccggcaaagaagaagcccaaaatagccgccataatggccaatgttttcgccgcatttttttcttttggcaacttaaagaatggcaccgcattgctgatcgcttcaaccccggtcagtgaactggaaccactggaaaaggcgcggaagattaacgccatggaaacgccgggaattgcggcaccgaccatcgatgttgccttataaggaatggccccggtcacaacttggtacaacccccagataatcatcgcggtcataaccaaaacgaagagatacaccggaatcatcaggaaattagcggattcactcattccgcgaagattcatgcccattaaaataaagataatgacaagcgagatggcaacttgatggccataaagcgctgggatcgcactggtaatcgcctcagcccccgccgaaacggaaaccgaaaccgtcagcatgtaatcaatcagaagtgaagcgcccgccgtcaaaccggcattcttgcccagattttcgctcgcaacgacataagctccgccgccacttggataagcgtggataatttgccggtaagaaagtgtcagcgagatcaggagaatcaacacaaacgccgcaattggcaacgaataccagattgctgcagctgacaaggttgtcaaaaccaagacaatctgctcagtaccatatgccacacttgacaaagcatctgacgacagcatcgccaacgctttgaagatgtttagctgttgtccgccttcttcggaagatttcaatggccgtccaataaacagccgcttcaaatgcatcattttaaactcctattaaccttaattgaaattttaaaaagtaaacatgcaccagtctacgctaaaaattgcccagcgcctaccctcttccatcttaacctatattgattggcaacaacaccgccattttacgaactcgcacaaaccaaaagaaaagcgatcactctttcgtctgaccgaaaaagtaaccgctggcaattaagccttctcgactatcacaacatcatgaacctttagcttgcgatggacttcatgttcaatctcgcttttggcagcatgatcgattttcaattcatcttttggcgtatccggcaataacttttccaagacaaaatcaatctcggtatctttgattgtccgtttatcatgcgtcagcacaatgtcaatttggtcaaagccttcgacataataaacatgtactgaaccaagtgtgtaaagctcaaagtatttaaccggtttgcgactatagagataacgcatggtattcggtagcattttatgcaggctggcgttaagtcgaatcggattttgaactagtttcatatcaaccgctccctttgctaatgtgagcgcgagaaattcattatacggaccccacgcattgcttgactgtcgctatcctggcaactttaaaatgataaccaagatgacttatttattttattttaccaaggaaagccggtcaatgcctattattgcgcttaatgcctctcagttgccatctttatttgttaatcatggtcatcttgtttcacgcctcaatgaccgtcagaattacccgaatctgttccttatgtacaacaaaacaccagcccggttggggactggtgttttttgcagccttaaacgccgaggcgaaattacatcataccgcccatgccagctgctgggtttgcgccggcagcggcagcgttgttatcttttggttcaggcttgtcagccacaactgcttctgttgtcagcaacagtgctgcaactgaggcagcgttttgcaatgcggagcgggtaaccttggttgggtcgataatacctgacttagccatgtcttcccattcgccggttgcagcgttatagccgatgccttgcttttctttcttcaacttttcaacaatgacagagccttctttgccggcgttttcggcaatctgacgaactggttcttccagtgcacgttgaacaatgttgatcccggtctgaacatcgccgtcttctttcaaagcagcaacagcaggcaatacgtctaccaaggcagtaccaccaccagcaacatagccttcttcaaccgcagcacgggtcgcgttcaaagcgtcttcgatccgatacttacgttctttcagctcggtttccgttgcggcaccaaccttgacaacagcaacgccgccagctaacttagctaagcgttcttgcagtttttcacggtcgaagtcgctggtcgtatcggcaatctgcttcttgatgatgttaacccgttcagcaatggcatccttggaaccagcgccatcaacaatggtggtgtcatccttggtaaccgtaaccttgcctgcacggcctaattgttcaatcttggtatccttcagatccaagccaagatcggagctgataacagtaccacctgtcaaggtcgcaatatcttcaagttgagccttgcgccgatcgccaaagccaggtgctttaacggcaacaacattgaaggtgccacgaatcttgttcagaaccaaggtcggcagtgcttcaccggcaacatcgtcagcaatgatcaacagtgccttaccttgttgcacgatttcttgcaagagtggcagaatatcttgaatattggagatcttcttgtcggtaatcaggatatatggatcatccagatcagcttccatcttgtcgttgtcagtaaccatgtactggctcagatagccgcgatcaaattgcatcccttcaacaacagagagttcagtatcaatccctttgctttcttcaatggtaatcacaccatcatggccaactttttccatcgcgtcagcaatcaggttgccgacttcttcattagaagaggaaacggaagcaacttgggcaatttccttcttgccgttaaccttgtggctgatcttgtgcaattcgtcaactgcagccttggttgccttttcgatcccggtccgaatgccgactgggttagcaccggcagtgacgttcttcataccttcacgaataatgctttgtgccaaaaccgttgcggtggtcgtaccatcaccggcaatatcattagtcttggaagcaacttctgcgactaacttggctcccatattttcatagtgatcttccaagtcaattgactttgcgatcgtgacaccatcattggtaatttccggtgcaccatagctcttgtccaaaacaacattgcggccttttggtcctaacgttgtcttaactgtgtttgctaactgatccacgccacgcagcattgcggcacgtgcatcctcagagaatttaatttcttttgccattgtttttattcacctcaaaattgatcgattattttttacgcaattgccataatgtctttttcgtgcagtacgaggtagtcttgaccttcatacttcacttcagagccggcgtatttgtcgtataatacagtatcgccaactttaacggccattggcagacgcttgccttccggtgtcaaagcgccttcacctacagcaacaactttgccggtttgcggtttctgttttgcattgttggctaaaacgatgccgccaacggtttgttcctcttcttcaacgacctcgacaatcacgcgatctcctaatggttttaacaaggcaatccctccacattacattttttgatttagcactcgttgtgtctaagtgctaactacaaaagtaactataacgagttttgcgggtgaatgcaacccccaaactccggaatgttatactaatttcagacattttttaaaaggagtcgtttatgtcacttcaaaaacatgctttttctattattggcgcctacttggttgccttcatcgctaacctccttatttttcaggtattgccagttgggcgccttagccttggtattgttaccttaatcagtatggtcgcactcattatcgcgattttgagcgagcgtaacttagtgattgccaacgcgattgaagcacctggcgttcttgccccgcagcaacgcgtcttctggggcgtgatgggcattgccggtgttttggcagcgcaactggttggttcgtggcttgaaaccattttattcaaaatgccgcaaaccagcagtcaaattcatcaacagctttccagtatgacgactaatccttggtactttttgaccattggcttagcattgccgatcttggaagagttggcttttcgtaaagttctgttcggcaatctcgtcaatgtcaccggtatctttggcggcgcgctcatcgccagcctcctatttgccgtgacccaacccggtggccactggcttagtgcaactctggtcgggttggtacttgcttacgattatcgccacaccggcgccatcagcacgccgatcatcgcccatgtcggtgccttatggatggtttggctttattacattgcccatgccctataaacgtaaccgaatattaatcgcacccatcaccacaatctcctataatggaaaataatgcttttacgaaggagttaaattatggagacccgctcaaatcaccgtcagcgtcaaaaaccccgccgatttcactggggaagactcatcggtttaatccttgtcgtcggcctgtttacagtcggagcttatgcgttgcgcttatacagtcaggcaaaatatgcgattgacaatacataccatgccaccaaacacgtcagcacggatattgcccaaaagaaaccatttgctgttttgctactgggggttgacacgggggcagacggacggattgaaaaaggtaactcggatacgatgattgttgccgtcattaatcccaagactaaaaaaaccaccatggtcagcattccgcgggataccgctgctgaactgattggtaccaaagaattcaatatgcaaaaaatcaatgccgcttataacgtcggcggttcggacatggccatcaatactgtctccaagctggtcaatgtcccgatttcttactacttaaccattaacatgggcgcacttgaaaaggtagtcaatgcagtcggcgggattgacgtcaacgtcccattttcattccaagacccgtataccggcaaccagaagttcactaaaggcaacatgcacctaaacggcaacatggccctcgcctattcccgaatgcgtcattcagacccagaaggcgattacgggcgccaaaaacgccagcaacaagtgatcaaagctattttgaaaaaagccatatcagtgggatcactcggtaatttcaccaaacttatggacacggtttccaagaacatcgccactaatatgagtttcgcagatatgcaaagtatcttcttgaattatcgcgatgccgccaagaccatctcaaccgatcatttgcagggcgtcaatgcctgggtcggggacggcgcctatcagattgcctccgatgtggaaatgcagcgagtctcaaataaactccgcacagctctcggcttacaaaccgaaacgattagcaatgaagaaaccaaacaaaacgcgaagaactcgcaatttgactttgaagccacaacggatcaaaactacattatttataccccttatgatcgttaatggccgttaactgtctggccgaacaatcatcaaaatcaatcagaacccacaaaaaagtcggctccggcgctgcattttcatgcgtgctggagccgacttttttacgccataaaggcatgtttgcataaacttcatgacttaaagccagtttcaaactgttttggttttcaacgatgtttgcgatcctacatgttctcgccgctgccaccatacgcctaacccaatcaccatgccaattgagacaacatatgatattaagcgattttgtaagatccaatcatcaaacgtatacggaatcaccacgagtgcatatgcgagaattaaccatcgcagcttcggcaacaataggacatcgcctgaatgttctaaggaaatccgatcaaacaaccaccttatcaggaaataaccgccgacactcgccagtatcgccccgataaatagtaaccaaaaaagttggttgccactgggaatcagcgtatgccaaaagctctttttgactgggccgtaaaatctaatcgaatttataaaccgttctattgcgctcatgccaaaccacgtaccaaacaagccaaaaacgcccatccaaaatagcgaggcaaagatcgtgccaaccccaatgccgactgtaaacataaaactgttgacggcgagattgattaataatgcacccacaatattagccccgcttagaccaacatacatcgcaggtacggcggcataaaaacctaaaagcgtgatcccaataccgattgttgttgcccctaataaatacgcaagaccatagccatagcgaactgaaaacagttgtcggcgccgaaaccggctcgtaaacagtgccgcattgagaccactggcttgatcaacgccggccatcgctattccgacaagcaaaggaatagcatacgaaacaattgtcatgaccagtcccgtgaaggatggtgcatacaatttctgcttgtcttgcggagcgattaaatacttttgttgttcttgatattggctataagacatgttggcaaacgtgtcatcatgatgctttgctgcctgccttttagtagcggtaaattcgctaggactcagcatgtactcctgacgattctggtagccttgtatcgttccgccaagattgagaaatgccagtaaaataacaaacacaaacacaacgcgcaacagaactttgtgccgtgattgaaccagcttcagtaactgatggtcatacattatttcacccccgaatgatgtggtcgaaattcaactttgaacaaatctgacaacgacagcggcaaactttcattcagtaccggttgctccgctgccaatgctgcttgaatctcctgattgaagtccgggaaaaccgcctcaatcacccgcccgcgaatattcaggattcggccatactgcttgactactgccggaattttattggttttaaacaccaactgtaacttcaccgcttgctgccgaacatcttcaagggtcaaatcgcgactgatgcgtccccctttaacaaacaaaacccgatcggataagccgtccaactcaatcagattatgcgaggcaatcagaaacgtacgctggccatccgcaaccgcatccacaaccagattgacgattttttcccgaatcaaaacatccaagccatcgaatggttcatccaagaaaacataaggtgcctgactcgctaaggccaacgcgaccatgaccagtgcctgataacctttagataggctctggaaacgggcggccccatttagcccaaacttttcaatcaagtgcagaaacgcggcttggtcaaagtcggtatacagcaatgcgtagttggcggcaattttaaccagtgaatatttgcggaaaaacaaatgctgctggtccaaataaaaaatggcttctcgctgggccggttcggttgccaaatcatgatcgtcaaccttcaccgttccgccatccgcaatatactgatgggtgatggtgcgaaaaatggtggttttgccaataccgttgggaccgactagaccgacgacctgaccgcgatctaacgaaaatgtaacggcttctagcaccggttgctgatcaatctttttttgcaaattcgtgatggtgagactcatgcaggttcctccttttcatttagccaggtatgcagcgtggcaagactgataccgagactctgcgcctcaaccaccaacgcatcaaatttagggcgaaaggttgccactgctgctgcgttggcatgtttcaacggttcggcaataaacgagccacgtcccggttcaacaaagataaccccgtcagcttcaagctgcttgtacgccttcgcgaccgtattaggatttagctgttcctgcttcgccatttcccgtacggacggtaatttgtcacctggctgcatgatgccttgaacgactctggctttaatttggagcaccagtcgttcatagtaagccaagtgagcataagactcagtcgccatgaccgcgcctcccttcgtattatgtgtactattatacgcagtacactgaaaagtgcaacataaaaacgccgcttgcctgctaaaggtaaacgacgccattacggtcttattcaggcttctggttcgttgagcgttggcccataatgttccaggaagtaaatcaatgtttgcagctcggtggctaaatccacattctgcacgcgaacataactcggtaccgaaatccgaatcggggtaaaattcatgatccctttgatacctgctttaaccaaatcatcggtaatgtgctgagcagcatcaattggcaccgtcaagatcacaatttcaatttgctgatctttaatctgtttaatcatttcatccatcgggtaaatcggaacaccgctttgaatcgttccagcgagcttaggattaatgtcaaaaccggcgctgattcggatgttgtttgcctgtcgaaaattataattcaacaacgcatgccccaggttgccgaccccgactaaaccgacattggtaagtcgatcctgattcagaatctttttgaagaaattgagcaaatccttcacatcataaccataaccgcgtttgccgagtgcaccgaaataggaaaaatcacgtcgaatcgtcgccgagtcaacctttaccgcgtccgacagttcagttgaactgatcttggttgtcccggaattagccaagaaattcaagtatcggtagtacacgggtaggcgtttcgccgttgctttggggatgatcgtttccgccatgtaagcaagcctcctgtagaagtattcccatgcagaacatgtgaactgtccaacatagtatcttctgcttatattagctggtttatggcctgaacgcaagcggatacatcttcacaagcagattttgccagctaaatgtatcagcggggaatgcgcgcccatgaacgaaactatgttatattaggtcttaacgattaattgtgaaagaaggtattcctgtgatcattttgcaggcacaacaagttggccgcagcttcaacggcaatgaattatttgccaacgtgaacctggagatccaagacggcgcccgcatcggccttgttggtcccaatggcattggcaaaacaacgctgctggaaatcctgaccggcattgctcccccggacgccggtcaggtcaccaccatgaagaatctatcaattgggtatttagctcaaaactccgggcttgattccgacaaaacgattttcaaagaaatgctgaccgtctttgctccgcttcaagcgatggcgcgtcaaatccatgatttagaggccaaacttggcgatcctaagctgattgccgatcaagctgcttttgcggccactatgaaacaatacgatcaactgcagcatgactttaatgaacaaaacggttatggctacgaggccgaaatccgttcggttctacacggctttcagtttggtgaagacacctatgataaacccgtggggaccttgtccggtggtgaacgctcacggctagcattggccaaactgctgctggaaaaacatgacttgattatccttgatgagcccacgaatcatctcgacatcgaaacgctgagctggcttgaaggttatctcaaaacataccccggtgcgatcttaacggtcagtcatgatcaatattttcttgaccacgttgtcacggaaatctatgaactggatcatcaccacgcaacccattataaaaccaattacagcggctatctcaagcaaaaagccgagcgccaggcccaagcgtggaaagcctataacaagcaacaagaagaaatcgccaaactacaggattttgtcgataaaaacattgtccgcgccagcaccaccaaacaggcacaggcacgccgaaaacaattggaaaaaatggacgtgctggaaaaaccgaccggcgatgataaaaccgtccattttaatttcacgcctaatcgaccaagcggtaatgaggtcctcaaggttaatcaggcaacagtcggttatgaagccgatcagccaatggcaggtcccatcgattttcaggttaacaaatacgatcgcatcgccattatcggtccgaatggggtcggcaaatcaactttacttaagagcatcttgggaaaaataccgttcttagccggcactgccaagtttggcgccaatgtcgatgttggttattacgatcaggaaattcaacaactcaatcccaaaaataccgtcattgacgagatctgggatgatcatccgatgatgccggaaaaggatgtacgcgctgtccttgctgccttcttattcggtgccgatgatattcaaaaaccagtgagcgcgttatccggcgggcaaaaagcgcggctggaattaaccaagttagcgctgaaacacgataattttctcgttctggatgaaccgacgaaccacttggatattaacagcaaagaagtgcttgagcaggcattaaaagacttcaacggtacggtcttgtttgtttcccatgaccgttacttcatcaatgaactagcaaccaacgttatcgccatcgcccctaccggcagtaccacgtatcttggcaactgggactactaccaggaaaagctggccgaaaccaaagctcaggccgaagcagcagcggctgagtccccaatgaccaaatcggaaacgactggtgccacttcttatcagcagtccaaagaagatgctcgagcagcacgcaaattgcagcgtgaagtcgcggatctggaaaccaaattgcaaacattggaacaacaagcaaccgccattcaaaagcaaatgaccgcgccagatgttttaaccgattatgttaaaatgcaaaaattgcaaaccaaacttgatgcggttcaacaggaaaccaaaacgaccgaggatgcatgggaagaaaaaagcattcaacttgaaacgatgcaaaatgagtctaactaacccttttcgttttgataaaagtttgccgttgactgtcagatgaaaagaatataaaagaactggttccaacaacaaattctgctgttagaaccagttctttttttgcacgctaattggtgggatgtttaaaccttttgatcaagtagtcccaatgcctggcgtaaaactttttcgccatccatcatcccataggctttcatgtcgattaccgccattggaatctttttctcgtcagccttggctttaaactggctttccataaaccggacttgcgggccgagcatgaggaccgaaactggctctgaggcgagcttgttgtccgcatcggcagctgcagttgcaaaaacatcgacgtcaataccatctgccgccgccgcttttttcattcgttgtaccagcatcgaggttgacataccagcggagcaaactaacatgatcgttttttgagccatgggaatcatcctttcgttaacaaccttatcaataagttaagtctaaccaaaacagttagacaacgtcaataaaattgctgtcgcgggtgacgattactttacgcgtgggcaaaactcaggccgggatcggcatttaaatcttcagaagcgagatgccgttttgccagttcaatatgagctgcagccccaatcatggcaccattgtcaccggtcaggcgcaatggcggcacaatgacatcgacatcgggaaaatgaacggccaaggtctcattcatcgcttctttcagcccttgattagcggcaacgcccccggcaatcacgagctgtttaaccggatattcggttagcgctttttgggttttgtgaaccaacacgtccaccactgccgcttgaaaactcgcagccagatcttcacggctgagtgtttccccaatttgatcggcatgatgtaccgtattaatgacagctgacttcaaaccgctgaaactaaaatcgagattgtcttctttatccatggctcgcggaaaatgaaaggtatcatgaccaagatgggccaatcgatcgacttcttttccggctgggtaagggatacccaatatccggccgactttgtcatacgcttcaccggcagcatcatcacgggtatcaccgatgatttcaaattcaccggcagcgcgcatatagaccagttccgtgtgcccgccggaaaccgctaatgccaacaatggatagaccaatggcttaacaaatctagctgcataaatatggcctgccatatgattgaccggaataagcggtaagtgatgggcatatgcaatggttttggcagccgttaccccgatcaacaaggcacctaccagtcccggtccatacgttacggcaactgcggtcaggtcagtataagtcacacctgcttcttttaatgccgcatcggtcaccaacgtaatctgttccacatggtgacgactggcaacttccggtacaacgccgccaaaccgctgatgactcttgatttgcgtggcgataatgttcgataggattttggtcccattttcgacaacggccacgctggtttcatcgcagctgctttcgaatgctaaaattaattctcttgctgccacattattctcccctacaatcacgatgatcgccgaaattacggcaattcccgatacatatccagcgcatcatcatggttgctgacataataaccttttttaattcttccatcttgaaaacctaacgagcggtataaccgtttggcaatctcgttattggttctaacctcgagtgtgatcttttgactgccgtaatcaattgcacggccaatcataaattgcattaaaaagcgacccagccccatatgctggtaagctggatcaacagcaatattcgtcacgtgcgcctcgttcatggtaaaccatgtaccaattaacgccaccatctgaccggcatcttcaacggcgaggtacaacgaatgccgtaccttgcgcagttcagagaagaaagcataacgatcccacggcgtatcatgataaattcgacgctcgatggccagtgctgcgtcaacgtccgcttccgtcattcggcgcaacagatattctttattgcgaacattgatcgtccgcggtttaaattgcaattcatcaggcgtcgtgcgttcaaaccacgacctaaactttctcaacataaacatcatgtcctttgccgggatgcgccttaagccagttgttttcggcttctgttaagcgtaaatagcgcggtacaaagtcataaaccgaaaccggtggcaagtctttgccaagctgtcctagtcgcaatgcttggggcaaattcagccaatccggggcaaaatgtgccaatccgccaagtgcctcaataatctggctccgaaacatggcagcatctacgccaacaaaaatgactggctggtgcaaggtcgataactccgtgagcagcagcgtcaatggaacatgtcgatccgtcaccacattcagcagtttacctttgtcccactgataaacccccgtgaacacattattccggcgcgcattcataatcggcacaatcatcgctttagtggcactgatgtttgacgctaaaacggccaagctggaaacaccaaccaacgcaatgtttagcgtatacgccagtgttttgccagtagtgaccgcaattcgaataccggtataggatcccggaccatcagcaacgataattttatctaaatcttcaggttgtaagccacttgcagcaaccaattcgtcaatggtcggcagcaattgttcgctgtgcgttcgcttgtgattaatcgttgtttgcgccaataatcgatcattatccaacactgcaaccgacatcgcctcatttgaggtatcaagtgctaataatcgcatatttaaacctccctccggcgatacaatcatggcaatagtttatcacaaatagcctcgaagcgtgagcatgtatatgcagagcttagaatataggtgtgtacttatactgctatgattgagcaaccaattgacagcaaaaccatcactttttgaaagagtagcagggttagattaaatcaacattaaatccacgcttgaccaggatcaggcaaagcaccgtttaaagccgccagcaaaagaagcacgctgccgacaataagcagcacctgtaacaagatcttaagccacagacgttgatgaatcacaccttctggagtccaatacaagtcggttgcactttgaatcccagtagcttcattctccgctaacaagcgatcgtgtaaccattttgccaaccaaatccaggccaagccggcaactataacactgatcatcacgacccacaaagcaagatcacgcgttgtcaaataattcgtagccatcacataaagacggctaataaacggcaaatggcgcaactcggtataaaattgatttccaagtgccacggcaaacgccagcccgctgatccaactaccaatcaacccaactcgacgaaccagacgcgcactcgcatcttcacgatacaagttacgaatataagtcttccgcccgctacgcacctgattcggatacatcattttatgcgttgtcaattgcatcgccataatctgccgttccaactgcaaggcccataaaccgactccagccaaagccagtgcagtcaaacctatcaacaaaagatacataaccggcaccctttctgtatggtgagcgcgagccggcgcgtttagaaaccggagtgtaagtggcctcaggcgtgatggcccgctcttggccattgcgactgaggtccttacacgcaggtttctgcgccggggagcgcgttatggtgagctgagcgcgagccagcgcgtttagaagtcggagtgtaagtggccttgcgcgtgatggccgggctttggccattgcgaccaaggtccttacacgcagacttctgcgctggcgaacgcgttatagtgagctgagcgtgagcaggagcgcttagcaatcggagtgtaagcggccttgcgcgtgatggccgggctttggccattgcgaccaaggtccttacacgcaaccttctgcgccgagtaaatcctccgcctaaacctttgattgtctattctaacaattaacggccccactgaccagtcaaccgctcagccacctgcttaacatcaaaaaagcactgaccctctgccatcaaatcatggccagaaaatcagtgctgtttttagccggtttcaacaatcaacaatgtcaattaaagatgtggtcgaatccgttcaacactttttagcgttgcgtaggacagcgccgtttgaattggcaacatgaccacgtttttaatcgtgcgcggccagataataccttgccatggcgtgcccatcatgtttagccacagtgtcgtcaaaataatattactaatcaacaacactaagccaaccccaagcaatgtccgaataaccgaaaccttcttaccgtggaagaacatcccgtaaatcatggctgcaatcgctgcactaagcgtaaacccaggaaagttagcgccaggattaaagatcatgatcgacagctgatcattcaatgctgctgcggctgctgccatccatggtccgaaataataccccatcaaaatagtggcaaaaaaagcaggactaatcttcaaccacggggtgccaaaagaaaaacggctcaaaacaatctgcatagccatcatcatggcgagatacacaatgtttcgagtggaaagcttgggactactaaacgataaaacttgcattagctgcaatctccttttttgcggagacgcctaaacatcaggcgaatgcggaacctgcaccgcgacatctgtcttcgtctgccgttcacattccgttccggcagcacttaacgcacaggttcctactcctagatttttgtaacgagtcttatcgtacaccgaaaattatctaaagggaaccccttaaatgttcgcattgccgttcaaaaaagccgtggtgaaatttatctcacaactttcacggtattttctagcgtgataccaacgatgctgccagactcttttgctaaaatattgactcgtaatcacatctttctggttgctctcattccctcatgtagggattcccttaacacttcactatcgaagtgtttttttaatcttttattttattaatcacttttcaaacacccttggcatcgctcatcatcagctgcgccacagtatttacagccaaacgggaaaaagtccagacttatttagcagcatttcaaaaccgcttaccagtggttttgacacgtgaccatcttaacagtcacgcctgggaaaaaagccgtataatgaatctcgataacgtgtgaaaggaagatccaatcgtgaccaaacacattcttgttttacatactgggggcaccatctctatgaccgaaactcgagatggcgatattatgccaagtcagcataaccctttgcttggtgccgacagctttgttcctgccggtgttgaactgacaaatgaagagatttttaacttgccttcaccgcatatgacgcctgaacggatgctgaccttggttaagcgtatccgccgcgccgaaaaggaaggggcagatggtgtggttgtcacacacggtacggacacactggaagaaacagcctatttccttgatctcacccttgattcggcaatgcccgttgttgtgacgggtgccatgcgctcgagtaacgaaattggcagtgatggcctggagaatctccagagtgcgattaaaacagctgccagcgatgaatcacggaacaaaggaactttagtggtcatgaacgatgagatccacaccgcgcgtttcgtgaccaaaacccacactaccaacgtcgccaccttccgcaccccgacatttggaccagtgggattggtgactaaagatggtgtgcgcttcttccaggaattaatcaatcaagaagtctgtgcgatagatcatcttgttgatcgggttttcttaatcaaggcctatgccggaatggacggcactttatttgacgccttaccggataatatcaacggtcttgccatcgaagcgcttggtgccggtaatcttcctcccacaacgctgccagccattcagcggctgctagaccgccacgttccgattgtgctagtttcccgttgtttcaatggcgtcgctcaagccgtttacaattacgaaggcggcggggttcagcttaaaaaaatggggattatcttctgccaaggtctcaatggacaaaaggcacgcattaagctgcaagtgggcctaagcgacggcaaacgcgggcaggcattggctgactttgtggataatgttgtgagttaagtttgggtaattaaaaaagcagttctaagtgatgaaaattgcttagaactgctttttattttcaaacaaaaacttttccctacgatgtttaagcactgaagtcatcccagatcatctgtgcctcggcattcacctggtcattggttacaacccgatgcaaggtgcgcgtcgggtcatcagggtcacgttgaaattgcgcggtcggcgtggtgccatatgcgacttcacgttcatatcgaatatctgcgccccgtaaagtatgcgtgctcaagaagtcataccccaggctgttttccatccattccagataatgagcgttattcacatgaccattgctatcaatgtcaaaataacgaacatgaaaagcttcttcaccatccggatcggtcacctttttaaaccgtggaaatcgattaatttttcggtttgaaaccgccccgacacgttcaaccagttcagggatcacatcaacgattttacgggtgcgcaaatccataatcacccaattgctgctcactgaaaccaaccgattgccttgcgcatcatcgatccagtaatcgcggtaagtaaaatacttattgtaggtggtggcttccgttccgacgcgtaaccgttcttcaatctttggcatgcggtggatatccatgtgatactgggtgatcacccacccggcatgaaactcactgatcgcatcaataccggcatgcaactgttccaattggcgttccgacacttccaacatgacattcatcatattggccaatccagcgcggccaaatcgatctcctagaaaacccggaattcgataatcttcttcataaactgctcccatgaaaaccccttctctttcaagctcggttttgtctcagtcctcagattctaaaaatacattcgtttacttatccaattcatgataagcatcataaaccacttgcttagccacgccattttgcttggcaaccaacttgattgcagcattgggcttggcaccggttgccacaatcgctgccacctgtgctctaagcggcaattgactgttgacagccggtttgtccgtcgcgccggctaccatgatgacaaattcgccttttaattcgttagcagcataggtttgtaattccgttaacgatccacggataaaggtttcaaactttttagtcaactcccgcgccaaaaccgcctgccgatcgccaaacaccgctaccatcgccgcaagcgttttgcccactcgatggggactttcatagaatagcaaggtcgccggttcgtttgatagcttttctaacacgcgctgcttttctcccgttttgcgcggtaaaaagccgtaaaataaaaacggctgcggtggcaaccctgacgcaatcaatgcggtagtggccgcattagcacccggcagtggaacaaccggtatgccggcttcaatcgccgcgtgtaccaattctttaccggggtccgaaatagacggcataccggcatcactcacttgggcaatagtaacaccgttttgcagttttgcgagcagttcgggaatgcgcatttgggtattatgctcatggaatgaaatcgttttggtagcaatttcaaaatggttcaacaacatctgggtatgccgggtatcttcagccgcaataagatcaactgttttcaaaagctcaactgcgcgaatcgtcatgtcagctaaattgccaatcggcgtcgggactaaatataacgtaccggttgtatgggtaccaaagcttcgttgctgctccaaatcaattctccccataaataatatcaagacaaaacgcacatggctcgtcattgacccggcgctggccataaaacattgggcaaacatggaagccttcattatagaggctttctaggttttgctttgattttgataattcaacgccgccgtcactggttttgttgtcgtctttttccagttcagccaagtgttgacgcagatgcttattctcgatttcaagttccgcattgcgttcaagcgtctccgccatatcatctttcatcgccgcaatttccttgagcatctgctgggcgtgtttctcaaggactaggaaaccatcgtacagttctttcttttccacaagatcacccttctaagagtttaagcattaactgttctgttgccgattgaaacgtcacattctgcgttaaccgcacctgagctgtcaaaatagcttgcaaggaagcagttaactggcggcttgataacttagccaaaatgccaattgcaggaatgtccagctgctgcagggcattcacttgaaaatggcgatttaaggcatccgcgtaagccagcccgatcaatgccaagacttgtcgctgtgcctcggcatccttggcaaccggcagtaactgggtttgcacgcgcacgaaactttccggatcatgatcagctaatcggtctaataactgaaaaacccgattaacccgatcctgaaaatcatctgacgccaatagttcctgtgcttcactgacattaccggttaagcgccctgccactcgcgccagctgcgaattggctccgccttcttccagcttggtaatcacagcgttacgatccggactctgaaaagtaatcacctgtgcccgcgataaaattgtcggcaataactgattcttagccgtcgccgttaaaatcaccgtcatccccggaaccggttcttcaaaaaattttagcagtgaattggccgctcctgccgtcattttatcagcatcttccacaataaacacgcgctgattgccttcaaccccggttttgctcatttcctgtttcaagttgcgaatgtcatccaccttgatactttgcgtactggttttgagcatcatcacatccggatgattatggtttaagatgcgctcgcactcaggacactcgccacaaggagcaccgtcttggacatgctggcaaaataggcgcagcgcaatccactcagccagcgctaacttccctgctccttttggccccacaaacaaataggactgggccaattggtgccgatcaatgacgcgggcaaattgggcaacaagcttaggctgcagcgtgttaatcagaaaatcagccattagaagcgatgaaaggcttcaatcggcagcacgaagacggtagccccaccgacttgaacctcaaccggatacgcaatcgaactatctgatgtcgcatcaagattaactggcggcgtcataaattgttgccgcgtctgggaagtctctttaataatcttaagcacttcatcaacccgttcgtcagcgacaccgataataaaagtggtgttgccggcttttaaaaatccaccagtcgtcgataacttggtcgcttgaatattagcatcaataaattggctgcttaacaggttactatctttgtcttgaacaattgcaagaatcagcttcataatatcctccctgcactagttagcattgtcgcacacgacctagcgcattccattccttacttcgcaaataactccgggaaccgctctgtaatcgtcataaacgccgcagtgacaaccgccgcaagtggctgagtcgcatcaacggtgacgattcgcttaggattatcggcaaccagtttcatgtacgcagcatgaacccgctcgtgaaaggccagactttcctgatcaaggcgatcatattgacgttcgccttgatgagccatgatccgatccaagcccacctgtacaggcacatccaaataaaccgtcaaatccggttccagccccgcggtcgcaaattggttcatttgtaacaccgcttgcgtaccgatttgccgaccgccaccttgataagcaacggaactgtcgacaaatcggtcacaaacaacgatgtccccgtgagcaagcgccggctgaatcacttcaaccaagtgctggcgccgtgacgctgcgtatagcaatgcttccgtgcgtgcatccatggccgtattcttgggatcaagaatcacatcccgaatcgtctcggaaattttcgcgcccccgggttcacgggtaagatgcacagaagtaaccgaacacgcctttaatttaggaattaatgtattcaagacgctggttttccctgcgccatcgggaccttcgaaggtgataaaagtgcctgtcacgatatgccgctccttttttggaattaagtccattttacttgaaatgtttcacaattaaaaacttatctttaaatccgtttcataaaagtcatgcaccaagatttgcagcgacataaaaacggtaaatgcttagatctgaaaaagagatcatcgccatttaccgttaatgtaaaatattgcgtgcttctaacatcaccgcgaagcacttttcccgactaaagggaagccggttcgagcacctgactgttactgatcccggaactccgcaatttgttcagccgcaactttggctacaatttcacccttgattttgcgggtgcgcgcctcacgatagagaaaatcgaataaagctgcctgtagcgcgacttgtgattttgtctggtcatcaacttcacggaaagttgccacgagcttccgttgtgccgccatctgatcacgaactcgataaacaagcatcatgagttcttcgtctttttcttctttgaccttgatctgcttgcgtccgaacattacagctcagtccttccttcaaccgccttcattaaggtcatttcatcggcatactcaatatcgctgccaaccgaaaggccatgagctaaacgcgtcactttaatcccagccggcttgataaggcgcgcaaggtattgggctgttgcttccccttctggcgttgcattggtcgcaataatgacttccttgacggcggtattctttttcagccgcttcaaaaggctttcaatgttaaggtcttccgggccgcgaccctcgattggcgatagcaccccatgcaacacatgataaaggccatggtagtcttgagcccgatcaatactcatgacgtctttgggctgttcgacgaccaagatggtgctttgatcgcgatttttgtcacgacaaattgcacacggatcttcatcggtaatattgccgcagatcgaacaataatgcagatcttctttagccgcgaccagacttttagcaaatgccgtaacatcgtctttgttcatatcaatggtataaaaagccagtctagtagctgttttagcgccaatgccgggtaagcgcatataactatcaattaacttactgatcggttccggatattgcatagtaacccctcttgctaaaatcgtgatcgctatcgtgctaaatgacgaacagctttaccatctacatgattcgactaaccgctattaaccgcggcgtcttcgcttacagaatccgcttgatggtgggttacatcggaagtccgcgtgtatacttgccaagtttatcctgcgtttgcttgtcaatgtcggccattgcctgattgactgcttcaatgatcaaatcctgcaacatatccggatcatccggatcaattgcttccggtttgatctgaatatctttcatgactttctcaccgctgaatttaacggtcaccatgtcagaagcagatttaccttcgaattctgtcgcgtatagttctttttgcgcagcctgcatctctttttgcattttctgcatctgccgcatcatactttgcatattacccattccacgcatatttgatcatcctttactagtcatttttgattgtcacattaggtgcatctttgccaaaaagttcagtcagtttactgacaaccgggggcgtctgtggcttagtctctttcgtttctgccttagctgccggtgccttgagttcctgaatatattccttgcgaatggtcggccagacatcgctttgtaccaaaacaatcttgggctgcttgccggtcaacttctgcaatccggtttctagttctgtcattaaggccgcatcgttcatggcccgttcaactaaaatatcatagtcgaagctgacaatcacgccatccggactggctgctaccggctcactgaccttcatcatcgcacgtttggtaatactcagcattcccaaaaggtcaggccagacatcttttaaattggttaaatcctgcttggttgccgcgccaagaatcggataaattgccttacgattaacatgattggctttttgttttttgactcggcgggtacgcggtggcggtgcaatcgtaccaccatttgcttctacccgcttaagttgatcgctcaactgtttgactttggccgatagctgctcaagttgcggcgtcacggcaggctcaggcgcagcttcgacaaccggtttagcggtctcgcttagccgaaccgtggcaacttccagataaatttccgggtgattggtcatccgcaattgttgctgcgtcgtatttaacacgtcaatcatatggtaaatctgcgtcggtttgaagttttcgctcaaaatcttgaattgatcgtctagcaggcttttttctaactcgcctaataacgcaggtgcttgttgattgaccaataaatcacgcagatactcaatcaggtcttcaatgaggcggccggcatctttaccggctgccagcaaatcctcgaccattttcaaagcctgcgcatgatccttagccaacaccgccgccagatatttgcctaaaacggctgtggtgacgccaccggtgacatcaagcgcatcctcagtcgtcacgtgattatcgccaaaactcaacacctgatccaggattgacaaggcatcacgcatgccgccttcagctgctttggcaatgaccttgagtgctgcatcatcataggtgatctgcttgtcatcaaggataaaacgcatccgcttcacaatatcttctggcgtaatccggcgaaaatcaaaccgctgcgtccgcgaaataatcgttgccggaattttatgcggctcggtggttgcgagaatgaaaaccacatgtgctggcggttcttctaacgtttttaataacgcattgaacgcaccggttgataacatgtgtacttcatcaatgatatacaccttaacgcgtgctcgtgtcggcgcatacttggccttgtcacgaatgtcccgaatttcatcgacgccattattggatgccgcatcgatttcaatcacatcggtcagactgccatcgttaatcgcctgacaaatttcacaaatattgtccggttcaccatcttcaaggtggagacaatttaacgctttggccaaaatttttgcgaccgatgttttcccggttccccgggggccagtaaaaagataggcgtgactcgtttgtccggtgatcaacgcattcttcagcgtcttggtaatcgcatcctgcccaataacatccttaaattgctgcgggcgccagacccgatacaacgcttgataactcaccttttcgccccctcatgaatggcttaacatttcaatcgtttagcataaagcctcgttctagtttaccatagccaagccagaagatgccttgtattctgacaacaaaaacggccgctttataacaaagcgaccggtcaatttctcaataacaaaaggcacatgacgaacctaccttagtgctgcttccttccggacctgacacaattcggaaagccatcattgccttaaggccttgcggcaaaaaccattatacctgatttcgatccgtttgaccagcctgtttggccgcttttcgttttgcccgaatcgcacggaaaaaatcttgcaataaggcagcacttgcaatggcttgaatcccggggacaacagcaacttggtgattgaatcgggtatcttccagcaaattataaaaagtacccgctacccctgctttcggatcagtcgcaccaaaataacaggtagcaattcgtgcattaatcattgtccctgcgcacatgggacaaggttctaatgtcacaaacaaactgcaatcttctaaacgccaggtgccaagttgacggcaggctgcctgaatcgccaagatttccgcatgctgggttgcatcctgcgttgtctcgcgcaagttatacccacgacctatgatttgctggtcatgcacaacgacggctccaattggcacctcgccgatagccgctgctttttttgcttcggccagtgccgcgatcatatattgattgatttccgaatccgtcattgccatcgtgaaaaagcagcctccattttagtgtgattgtcagcacaagcctccagcggtttcatataccgccaaactcgcctcataccgattcttcttattgtaaccatttaaaagaaccgcccacaaggaaattttcccatggccggttctttttagatgattgattctttaaaactgtttcaaacgctcaacgactcaatgctgctttcaagcgatcaaatgcggccagcccttgttcgcgggctgatccggcatactcactggcgctgtctttgaggctgcgcaacttatcactgacccggagcagattggccacgtcatcatcgcttaatttgtccaaaatgctttgaacccgatcattgtcaccaaaaatcttcttgacgaagccttcaacctgtttccgctgatgcctgcgttcaaaatattccgttaaattcttggcacaaacaaatgcgccggttgcaatgacagcagcggcaacggcacctgctgctaggtacttcgaatttgccatctaaatctgctcctttctatcctagtatgagtgtaccacgtcacgtattaaaactgttatttactcgctttgagaatgtaataaccgtgctctttcttaataacttccgcgttagcataagtggctttcattaactttaatgcagaaggcgcaccttgctttttttgaatgaccgcatacagctggccgcctggcaaaagatgcgcggctgctccggaaagaatgccggaaacaatggctttacccgcacgaatcggcggattggtcacgacgaccgcaaactgatcatcaatgctgtcgtacatagaactttcgatgatcgaaacattggtgatgccattatcagccgcgttttgctttgccaaggcaagtgcccgttcattgacatcactcatcgtcacttgccggttcggaaaatgctttgccagtgccaacccaattggcccatagccagcgccaacatcaagaatcggcccatcaggcaaggtttcggccaagaccgttgcaatcagaacccggctgccgaaatccacggtatgctttgaaaaaacaccgttgtctgtggtgaaacgcaaccgatgaccgccaagttcgaaatcaaaagtgcgttcatcgtgggcaagatcaggatcgttcgtataataatgctgcataaaagcctccttgaacatgagcatgcgtgcaactcggcacaggtagatccgagcaaacaatcgcgtttagatttactttaacgactattttacactttgtccgcaagcatgcgtagctcactagcccgcatctaccgccaactgtttatttgtcaattccctggccaagccggcttacccaagccaaacgcttaggccaccacttaacgggcgatgcaatggtcactttttgattaaccaccatcataatctgcaacaacgtgaatagtaaagatgtccgcttgcgataagcgacatatttaggaacccactctgttacgtatttgtttttatatgagcgtaatccttggaagccataaaaccgatagccgtattcataaaccaagtgggcaatcttttcctcgatgaaagaatagtcagacgttcccacattggcaagtggcgccatgcccatattgaaatacttaaaaccgcgctgcttggctaattggaacaggttgataaacacctcatccataattcctgacggcgcatcagcacttgaacgcatcaagtcaatactggtaacttcctgattaccacttggcatatcagaagcaaacgcaacgatcttaccttccgggccgcgaacaaccgcaatcggtgcctgattgagataatggcgatcgaaaaagccgagactaaaccctttttcactacgcccagccaaccacgaatcggataccgctttgagttcctgcattaacgcatcgtcaaacggtggttgcagtaattcaaccgtatacccttcccgttcgaatttatgcattaatgcgcgttcgcctttgcgttttgatcccgccaaggtaaaggtcgtgacatccacataaccttcctcaccaaacttcataaaatcaaaaccaaactcgtgcaacttcatcgttaggctttcattgatttcataaaacaccagtgatagatcctgcttatcggcctttttcatgaaatcaccaattgccgcagccatttgggtttcatccccgatcggttcgcccatgataatcagtttgtccgctttctttttgaataagaagaaaacccgatcctcaccgtctacttggtaaaagtgcagcgacttatcacgcatcaaagccaaatgactgacttcattgccgccatatttttcaaccactgcctttaagcgctcctcatcataaggatccgccaatggtttggaaggcgccgacaagtaacggaaaattaagtacactgttaacgccgccagcatgaccccgattaaagtcgtgaaaaacatgcgctcggacgggaataagaagacgtccggcacatgacgatggtgaatcgccggggcattataaaacgcggcgaatgcataaaagatgaatgtcagcccaaaaaccgccccatcaatcagcttattgccccacgataaggccagccgttcacgagtcagttcccgccgcgtcaaaatcaaggccaggacaaccaataccaaaaaaacgataaaacgcaggtgattgtcctcgcgcaatgacgcaatcatggcgacgatcaagacgatgacagtcggccaataagcgcgtttgacccgactggcaataccacgcccaaaccccagaatcaggaatgccacaaccacattcgtcacccgatccaaaaataggaatgtatacggatatagtcgttgataaagcgtattccgaaacgccaagtccggtgctaccccgcgcaacagcaacatgatcccggaaaagtacaggaaaataaccaaaaagccgaacgcgactttacgaatcagctgaaccggcaagccttcaagataagcattcaaacgtttccctgcatcttgagcaaacagaccggcaccaatcagaaatggaatcacatagtaaaacaatcgataaaacaacagccatacaacagcaacattgctatccagtcccaactgtccgagttcaaagatcatgaacacatcaaatgaacccagcccacctggcaccattgaaataactccgatcacattggctaccataaatagcggcaacactgacatcaacggaatccggacctcaagaaaataaccaatgagcaagaagaaagctgcacacccaccccactccagaaacgagcctaatgttaagcgcaactgccgctttaatggcatatccgcgaagaactcactgtcgcgcacgtgggaaactaacatcaacaatggaaagtatgcagccccaccaactagccaaatccaataattggaaaattcagcgccaatcccgaaaacaaagataatcacaatcccaatcatcgaccacagcgacaagccagccaacaagaacatggcgatcttagaaatagcaaatagaacctgcttttgcgttgccttttcatgatagaaattggcccgcaaactggctcctaacaaaccaccaaaaccggcaatgttcgtaaacgtattaacaatccaaccggacttaataacataccggcgtggatagtcgcccggcagtaattcggtaataacaaaatcatacgtcagcatcggcgtcacagcaatcaagcccacgattagcaaaatgatcagtgacccgggactttgcgtggctagactcgctcgcatctgttcgccgctgagatcttgactaatgcggcctacctcgaaaatcacaaacacaaggactgccagcacaaatagcacctttaacgttgtgagatgttttttaaaaaacgttccgacttttcgaaaaagtctcttcattattttgcgccctccgtgtttgtattcccatccattatatggaaaacacgacccgcccgcactcattctgacttttttgtaagacactgtaagtttgcagaaccttaacgcgttcactgagtcagagatctgcgtgtgaggaccttggtcgcgagggtcaaagtgcgatcatcacgcccaaggccgcctacactccgctccctaagcgcgccggttttcgcgctccatataaaaaaggaaaatttttagtgtgaaagcgcttgacctgtaacgcgttacacaaattacactgtgtttgcagttaggaaatggttttgttggttgttagagaagacaggttaacgaaatttggttgcgcttatcatcacgcgctccccagcgcagcagtctgcgtgtaaggacctcgaacgcgatggccaaagcccggccatcacgcctgaggccacttacactccgattgctaagcgctcctgctcacgctcactttcattaggaggctattttcatgttaatgcaaacacatttttactctgaacttcccttttatcaccctacacaaattggggctttgaaggcgattgcgttaaagctgaccactgactatgactttgattatcaagaagttctcagttcactgttagcaagcgccgcagaggagacacaactgctcagtgatcggattgttttgacttacggacacgttagcaagctatccgcgccaatggtgatcggattcgactttgggtcccaattaccgtgggcggctggacagcagatcagcggtgcagtcgtgctgctagtgccagtctcaactgctgatcaaaccatccatgattggcttgatgcgattgcaacgaacagccgcgataatcaagatttagaagctgtaactcaaacggcaactgctgctattgcttaaagtccgcagtcgcgtatccaagccgatatgcgtgcacgttaaacgcgctgcatgccatatcggctttttcgactgggtgaatcgactggtatactgtgtgtggaggtactttcatggcgaatattcacgacattgcacgcctatctggttactcaacagcaacggtctcgcgcgtgattaatggccatcgttatgtttcggctgctgcccgcgctagaattctgactgttatgaaacagcttgattatgtgccgagtacgatggcccagaatctaagcgctgggaagacccggacaatcggtgtcactttacctcataccgatcatccctattttgaacaattggtaacgggaatcttaaacgccgctatgatcggcaactaccacgccgttattttaccctcgcgttacgatcaggaacttgagcgcacttatctggaagcactgcgcagacaagcctatgatggactgatcttcacatcccacggacttagtttaagcaccattgccggttaccaaagatatggtccgattgttgtttgcgaagatccgggccaggttaaacttgccgctgcttacgctgaccgcactcccgcttatcaagcggcatttagctggatgaagcggcaaggccacactagaatcggtctcttgctgagtcgaccttacgcgcaaagtgccacaagcaaactcacgattaatagttatgtggatgtctttggtcaccgtcccgagcaatctttggtggtttatcaaatgcgtacttttcaagatggttatcgcgctggaaagatgcttgcggcgaaacagcctgattttattttgggtaatggtgacgatattacggcaggattgcggcaatattttgttgatcagcatctccctattccgccattaatgggtcaggaaaatcaactttccagtcggctactaaacatgagcacgattgatcatcatgtaaccgccattggtgccgcagctttaaaactggccttgcgtgcagaagttgctcagactgtgattcagtccgatttaattcttcgtgattgatttttgtctattttaaccaaaagaaaaaccggcattcagcatggcgtttacacaccatatctgtatgtcggattttttaaaccatagattcataaccgagcgttacaacgcttgaccggtagtcgatacttgtaacgaatcgttttaaagatagtgattagctttgcttgcgtttacgcttgatgccaagaagacctagaccacccatgactaaagctcctaagaaagcaagtgccggccgtggcgattcatttgtacttggcagcgtatctttagtggaagcttgactgctggcaccattactattggcgttttcggtccctgttggttgtgccggcgtttcttgcgtctgtttcttgtcgtcgccgccctttggattggttgatggtgtggcttttggttgatttcccttgtcagttccagagcctttaccggcatctgaaccgcttccggtgtcagagcctttaccagcttcggaaccacttccagtgccggaacctttacctgcttcagaaccgcttccggtgccggaacctttacctgcctcagagccgcttccgctaccagatcccttacctgcttcggaaccacttccagcgccggaacctttgcctgcctcagagccgcttccgctaccagatcccttaccagtatcagagccacttccggatccgcctccaggttgctgtggtgtcttggcagctgcctcaaccgctgcggcaattttagtcttcaaaccaaacaaaccttgcaattgtgcaatcttttcagtatccgttttagctgctgtacctgcagcaatgacagcatcaacatcaccgtaccaggttttaccggtagtggtatctttggcattaccaactttgacaggcgttgccgctttaattgtttttgccaattgattcaatgcagcatctaataccttgttgaagttggtttcaatttgatcggcggtgctagttcctgctgtcgtttgcgcagcgacagcgtccagttcggcatttagcgttttaccggtgcttggatcggtttggccacctaaatcagttccaaacgcctctttggcagattgtatcttgtttagtaatgcagcttgttggtctgctggcagcttatcaaccaactgattcactgcggtggtcagctgcgttgttgccattgtgagtgtttcaatcgtcgcatcagctttatctaaagcagtctgcgccgatccgatagcggtattcaaagcatcagttgtggcgtcagtatattgagcgctcgttgcttttgcctttgcttgagtaagcaaatcctgcagcgttgttttggccttttgtaactgtgccgggtcatccgtcttaatattcttaaccgcgtaatctactgccggcgattcgttaccgtataaatcaacagccttaaatttaaagtctgcgtttgccgatacactcagtcccgttgtaggtaaatcttggtaagtcttgccgccatcagtactgtattgaacggtctcacctgctgccgccttggctgtcaacgtcacttctttagctggatcagtcgtatttggcgtaattgttggcgctgcgagtgtcttcttaggctcataataaaccgtaatctttttagttgtgacattactgccgctatctgttgccgcaacggttaagacgttcttgccctctaatagtttaaccgtctgatcaattgccatatgacccggctgcccgctgtttaagttaatgtcttcatattgactggcaacctgactaccgttaattgccagttccaaataattaacgttatctgtcgctgttccggtgatacggaaattcggatcattcgtatagacaggtttgtccgttgagctatcgagtgacagtgtcggggcaacagcatctaaaataaaggtcaagctgtcttgaaccgttttatcttgcgtggtatcaccgattacaacgccaaacggtttctgaccggctgtccccagattcaacttaaaactaaaggttagatcatctttaatcggtacttgtttgccatctacttgcaaagtcgtcgtcggatgcttgactttgccggtaatcgttgcaatcccggtcttagggtcatagtacttagcatctttaactttcagttgatttgctccgaaagtgacgccttggtcgaaggtcaccgcattttttagaacatcggcatcataagttgagtttaccttctgctgcttggtaacggtattgccatcttcatcttctgccgtcaccgtaatggtattatccccatagttaacgggtacatcgccactaaagtgatgtttggcatccaaagtaaccggtgttgtcgtgccaccgttagtaaccgttaccttcttagtgtcggcactagctgttccggttactttaacggtactttcggacgtttgatcttgattatcattaacccgcaagtcactaaaagtaggtgccgccaaccggacattcgtatcaaaatgcttaactaactgggtatgtgcttggtcagtataaagatcaaccttcgtcgcatagtcgctagcgtcaagtgccatagtggctttgaaactattggcatcagcgtcataagtggtcgtcaaatcatgctgctttccttgcgcatcggtataggtaccataaacagcagctggatacgtcccggtaaaggtgtaagtgccaccttgcttccctgcttgatagttagccgtttgactcgtgattttatctggtaaaccaccaccattaataatcagatcataagcagttgatccgggcttttgtgcggaagctgattgatccgtggcgtttgaggcgttatcggtcaaataaagttcaacattattatcgccttgacccaacgcttgtgcctgcttatccgtcagtggcgtttcgagttttgtgtagccatcagcagttgtccctgtcgtcgtaaaggtgccatcaagattggtgacttgattaaccgatgtttttgcactcttagtggcatccaaaccgcttcgatcgtcttttgcttcagcggtgagatagtaagtggttttgcctttttcctgtctagacgttaaagcgacatgacgaaccgttggcgccttagagtccagtgtgaatgctacatcgtatgtctgccgcttgtcgccgccttcaggaacacctgaaatacgatacgtgtaattgccatccgcggctgttttgatgttgccatctcgttgatcataatacgtgccatcccaggccggtgcgcggtaataagtatagttgcgaccagttgaatcataataagtcttagtctggttattcgagctgctgagtgttgttactttgttgccgtgattatccagcacatcgacttgcacgtcgctaatattgcgtaacaggtagtattgcatgctgatgtcgttataaagtgcgttcttatcgctcgaaaaggccactgctttatcatcaaccgtttgcttgccactggcatccgtgactaagccgccgtaatattgactgccggttttcttattggtgagcatcggaacagtcccataattgccaccagttggatcgtaagtcacaccattcagactatccacgatcttcccgtcattccaatcaccaaagaagcccatatatggcaagttgagactcgagccatcatttcccttgaagttcaagaacccttcaacaaactgttgctgatcaaaagtcttaggcagtgaaagcgtgaacggtacctgcagggattttccagctggtaccacaatatcggtatccggcttgactgccgcatcagtaattttcttgtcatagagcacgcctgaattcggatcggtagccgaagtataaaccgcattggtatcttcattgctagtcatttgatacgtcagctgatgtttggtgcggttggtaaacgtcaacttaaacgttttggtagtgcttgtgaaatctttcaattcaacagcaggatagccgttttccgaaacaaccgttgatggattcttctccaaagcatcaatcgcggctttgacatccaccaaccctgctccctgtcggcgtggagagacgatgacattatcatagttaatatcattaatcggctttgcagtattcatttcaactgttttgagaaaatcggttaatgctgtgcctttaagttgcttataatcggcatagaattcattgtctttattatttagcgcttgttttagaagtgcctgagagccggcgataaatggagatgccattgaggtccccgacatattcgtataaccattgttgttttgcgttgaccaaatattaccacccggcgctgtaatatcaggcttaaaggaaagatcagatacagggccatatgaagtgaaacttgacatccgatctgctttataattttgatttggcaacaacgccaaggcaatttttacgcccagactgtcatttggatgcgcagttacccagtcaaccagtttttgaccagtcgtattggaaagaccaaaagtaggaaaagtagccgttagagaaatcgaagtcaaaggtgtggatgtgccatcattattaacaatgattaagcctgctgccccagcggcctcggcatatttctgcttgtcagtgaaagtcagactgccacgtttgacaatcgcaattttccctttggcatccgccgtatagtcgccagcatcacctgtactcaacttaccgcttgcgtctttgacaacgtagaatttcttctgatcaaaactgtcaacaaagtcattgcttgaaagctgtacggtttcaggcccgagttttaacccactgccgtcagtaatcgtaacagcttggttgatgacatctgtattctcggccgatgcgacagttgttgccccgcgtgatgtccccggtgtgccaaccgtctcattatcctgcaggccataataatctttgttgacgccttctgtacctgacccggatgtaccggaattccctgctgaaataaccgctgcggtcccggattcattggcgttttgaacggccgcaatttcaggatcctccaatgtttgattgccggaaacagacccaagggacatattcaaaacatccgcgcccagtttggctgaatcttcaatcgcagaaacaagcgttgacgaaccagtcgtcgctgatgtgtctgaattggtaaacaccttcatcgctaataattgtgattctggtgctacaccgacaactgacttggttggatcatcacctgtaccgttagccccgatgatcccggaaacatgcatcccatgctgttcatcaaccgtgtcgtcggtaatcgtgtcattgttatctgcgtaattaaagccatacggaaccttagccgtgaaataacgcccgtgtttagcagtactggtgaatttttcaacgtctgttcgggtcaatttggcctttttagtatcactaagccgcatgtccttatggttggggtcaatcccagtatcaatgaccgagacaaccgtgccttcccctttatacttgtaattagaccaaaccgcctgcacatttgccattgaattggccttagcatcggttgggtaataaaccttggctaaagtaacggttttaacgccggggatttgtttcaaccgcggaatatcagcgactttgactttggtggtaaagccattaacaacgtaaccatagctttctccagctgtctgatgcgtcacttgttcaacggctgatttaacactggcttgagccgcgatgacctgatctgttgcctgctgaatttcggcagtactggagtaatcgggtttcagcgtgccattttcggaagccggtgccgcgctcatctgcacaataacatcgacataagtatcctgttgctgaactttatttaacttgttgtaatcaatgccttttgcggctaattgggttgcaatggcttgattggtcaccgcactggtcgtgtctttggcagtttgtccagctgaggcagtcttggctttcgctaaatttgttcctttagtttgttgcgagattgccgctttagcttgaacttcaccaattggcaaaacagaaagtgctcctaaagcaactgtgctggctaagagaattgatagccctttcctttttgtttgcatcctataccctccgattcccagtaatttcaaaactattcaaaccttggcttgatatagttaagattatatacagacactcaggagtttcaacataatttttaatcttttattaattttcttatttgtaaaaagcctctcatggctgagatactaggcgattcaggtatgtcgaggaacgaaaatgtttaaattatgtgattatgaggaatgtgttgagttttttaatatccaacgttagaatgtagccacgatctattccgcaatctgtaaaaggagattgatttcatgaagaaaaaactgcgcgttccattcttagccgcaatgatggcatcttcaatcatgctattgagcggctgccaatccaaacaagccgatagtacaacggttgctacatactccggtggtcaggtcacacaagccagtttttataaagagctcaaacaatccccgaccaccaaaaccgttctcgctaacctgcttatctatcgcgcgctcaacaaagcgtatggaaaatccgtcagcaccaaatcagtggacaatacttataacagctataaaaatgaatatggtgaaaacttcacttcttttttgagtcaaaacgggtttagtaagagcagttttcgccaaagcattcgaaccaacctcttaagcgaagtggcactaaaaaagttaaagaaagtcaccaacagtcaacttaaaaccgcttggaaaacctaccaacccaaagtgaccgttcagcatattctaactagcgatgaaagcacagctaaacaagtcatcagtgatttagcagctggcaaagacttcacgacgttggcaaaaacttattcaatcgatacctcaactaaagataaaggtggcaaagtaagctttgaatcgagcagtaaaagtctcgattcgacttttaaagatgccgcctacaagcttaaaaacggcgaatatacacaatcaccggttaaagtcacaaatgggtatgaggtcattaaaatgatcgagcacccggctaaaggaacattttcagacagtaagaaagccttaactgctagtgtctattcaaaatggtcgcgtaattcaagtgtgatgcaacgtgtcattagtcaggtgctgaaagatcaacacgtcaccatcaaagataaagatctagcggatgcgcttgacagctataaacaaagtgtcgcagccaattagtccttagtttgcgcatatgcaatgagtttcttcctatttaaataacaattttgtcattgatgttgttatttaaatcaatgacggcatcatgagtttgagttgttatcttcggcagccgtttaactttatacaaaaagcacctcgcctttcgcggtattaccacgattaagcgaggtgcttttatttgaaaatgagactagattatttcaaagttacggttgcgccgacttcttcaagctgttccttgatcttgttagcgtcgtcttcggacaagccttccttgataaccttaggagcggcatcaacgagacccttagcatccttcagaccttggccagtgatttcacgaactgccttgataaccttaaccttttcttggccagcttcggtcaattcaacgtcataggtatccttggtagcagcagcatcgccaccagcagcgccgccagcagcaacaggagcagctgctttaacaccgaattcatcttcgatcgacttaactaagtcgtttagttccaaaatggaagcatctttaagttgtgcaatgatgccatctacatctaaagccatgtttgtttcctccgttttttaaatagtttgtaacgtaaaattatgcagcaggttcttcgtctttggattctgcaattgccttgacaaccaatgcaaagtcgcggacaggtgcctgcaagacagaagcaagttgcgacagcagaccttcgcgatctggcatcttggacatttccataatggtgtccaatgaagcaaccttgttttcgatgatgccacccttgatcttcaatgcatcaaattggtcagcgtacttggccatgatacgggcaggggcaacaggatcgtcattggagaaggcaacggctgtagggcccttgaaaacatcatccaatgcttcgtaaccgttggcatcagcggcccgacgcaggtaggtgttcttcaagacttccatcttgacaccagcctcgcgcagttccttacgtaatgcggttacttgctcaactgttaagcccagatagtcgacaacgacagcactggtagcattcttgaattgttcagaaatcgtcttaacgagttcagctttttttgcgatagcttgttcactcatgtttttcacctccattagtttggttgaagtttttagcaataaaaaaactccatgtctaccaagacatagaggtatctactgtttccgataccacctcggcaggatgattaaggcttgcgccccctgagtcttaggcagagtgactaatcacaacgagtagaataccatggtcggaggttgatgtcaaagtgtttctgcaaaaatatattttgtgcgaatgccgagacttcaacaatcgtaaactgacacgttgaattgtaagcactcacagattgcgttatattagttaggtaactaattttttgaaaggaagttggcgatcttgccaagtaaacttaaaagtctcgagccatggcagcaaaatttggctgtcttatggcttggcaccttcatcgccggcatgggttttagtgaggtttcgccgtttatctcactctatgtcgaccagctcggcgattttaccaaaggccaactcagtatctactccggtattacgtttggagtcacctttatggtagttgcgattgtcagtccgctttggggccgactggcggatcgtcgcggccgtaaactgatgctgctgcgctccagtttcggcatggcaatcattattggtgcgtgcgggtttgtgcataatgtttatgcgctcattgcattacgctttttacaaggattggcagctggttacattcctaatgccagcgctctgattgccaccgaaacgccgaaagcaaaaagcggaactgccattggaattctgacaactggctatgtttccggtaatctgatcggaccgattctaggcggatttttggcccagacgttttcaattcggctgactttcattattaccggagccttactcatgattgtctttgtgctcagcttaaccatggtgcatgaacactatacgcctgatccgcgcttgctgaacaagcaaaagcgtcccggattgctcactcaagtcggcaatcccaaggccatcatggtgttgttgatttcaactgccatcattcagctcggaaacatgtctatttacccaatcatcagtctttatgtcaaggaattgatgcataatgtcgggccgatcacagttgtcgctggtatcattgccgcattaccaggtatttcaaatctgatggctgcaccacgcttggggcagctgggcgatcggatcggatccggaaaaattctggtcagcggattgatttttgccgtgatcatgtacatccctcaaggtattgtcggcagtatttgggcattaggctttcttcgcctcatgatcggggtttcagacggtgccttattcccaacgattcagacgttactttcgaaaatgacaccggtgagctataccggcaccgtgtttagttggaatcagagtgctcaggcgttcggctcaatggcaggttcactggccggtggttttatttccaacatttttgactacaatggcgtctttatttttactgcattatgcctagcgcttgaccttgcaatggtttggatcttcatccctcatatctggtcaagccggccacgacaacaggaatagcgataaggtcgcatttcatcaagatataactgcacatcggtatcactaaaagcgggtctagcacttaaactagagccgctttttgcatgcgatttgtgccaattaatcaagtttcatttgccaggtcatcagcggatgcggatccggtactgccagctgctgataaacggcccacgcgaatgaatcagtatcatcaaattcaccgttcaccaccgagaatgctgcctgaagccgcggtagaactgcgcgcatcagccgaagcgtatcagcaagccctgttccaccgagccaagcactcgtgagttcacctggctcgtcttcaaaccagaagacataagccaaaatggtgccgccttcaaccaaaaagctcggctggttcggatcggcttctcgcaacgattgttcaaattgcgtctgtgtcatcgtggccggattagcggtatgcgcgtccacataattttgataacttaaccgaaccacggcttgccactgagcttcggatagctgtgaccgtgccaccacggtatcattagaagtcgctgctgcaattttccggtagtgactcatcgctgtgtgtcggataagctcaaaccctgtccgttgcaatcgctgcgtcaacggcgatgctgcagtataagtgctaaattgcagccgatcctgctcgtccgtcattttcttgagtttggtgagcaataaaggaagccatgagctttgaccgatgacattaaaatatagtgcatgatgatgataagcgttttgccatacagctgccgcaaactgtatcggaccggtttttgggaaacccagcaaagtcgccgctgagttggcaaaaagtcctttcgtccagtcatcggctgtttccagcagcggccggatgtcagctaaagtaacctcgcggcagcccgcgtgattcaaattagtcatgatgatcggtatccttttcctgctcctgattgccgtgcaagtgcatatacccataagcaaagcgagccacaccataaatcaccggaaccacaaccccgatccaaaaatggtttgtcagataatactgcggcaatggattcatatcgagcgcggcttcgtaagccatttcgattgcaaaaataatcacggccagcaacagtgctgataaaaccccgcgcgcaaccgcaaaccaaacatattggcgataggcttccggtgtgtccgcttcaattacctgcaaacgatagtagtacaaacttgtcacgttcagtaacgcaattgccaccgtcactaacagtaaaatccacgtactggcagtaattagcttaaggctattggcgtcgataaaaacagcaatgacacttgcgataactaacataagctcggcggttagcatattgcggcccataatggcgtcataagtgcgctgtttgaaccgatccttaagtgaaataccataataccattccatgattttcttcatcaattattgccttcctcactttttacaatgtcgttttatcttaccatgcctcacgattgctttttccttgaatcctccaagctttgaaaattatttggcttttcactcgctactttttgttaacgccacgatcccttcttcacctcagacgtgcttactatgaaaattttcattgacagacccgcctttttttggtgaaataagtaacatgttttagggtgtcaagacacctaattaatgttggatttctcaagggggataacgatgtcaaagaaagcacctagccatacgcggttaattatcggaatcggcattgcctggctgtttgatgccatggatgtcggcatgctgagttttgtgattgccgctttacataaggaatggcagttgagtacagttgaaatgggttggatcggaagtgttagttcaatcggaatggcagttggcgccatcttgtttggcatgatggcagatcgtttcgggcgcaaagccattctcatccttacattattagtcttttcgattggcagtggcatatctgcttttgccacgggttatggtatttttcttgtactaagatttattattggcgctggtcttggcggcgaactacctgttgcttcaacgttggtttccgaaagcgtcccggttgaaaagcgcgggcgcagcgtcgtcttgcttgaaagcttctgggctgcggggtggctactggcagcgatcatttcatactttgtcatgccactctggggctggcgggtcgccatttttgccactggactagccgggttgtacgcattttacttccgtgaaggcatccatgaatcgcgcgcgttcaaaaaagtggcgcggccggggttaatcaaaaccctgacaaccctctggcggccaccatatgttcgttcaacactcatgttgtggattgtttggttcatggtggtcttttcttattatggcatgttcctgtggttgccaagtgtcatggtgctcaaagggttcagcctcatcaatagcttcggttatgtgctgatcatgacccttgcacagttaccgggttactttgtggctgcctggttgatcgaaaaatggggtcgaaaaactgttttaagcctttttcttctcggcactgctggtagcgcgctaggctttggcatggcaaccagcttaccgatgcttttgactgccggcatgctactttccttctttaacctcggtgcgtggggcgcgttgtatgcctattcgccagaacaatacccaaccattgttcgtagcagcggctctggcatggctgcaggtatcggccgaatcggcggcattgtcggtccgttattagtcggtcacctactaggcgctaattggtccgtcacgggtattttcggaatcttcacggcgtctatcctcattgccattgttgcgattattttccttggtaaagaaactatgggcgttaagttagctgacaccattgaaacttctgcagcgaaacagtagctgtcattgaaagctcattttctttataggaaaacggtagagtatactaagatggtttttcactcagtcgtcaagatagttagttagagacagtttataataatcataaagaaaggcgtactaaaaacagtacgcctttctttgtggccatggattatttcttaaagtggctagattacccgcaaaaccaatttaaccacatcaatttcaaacatttgtcacacagaatccataaaaaaacgtgcttaacaaaaaagtggtgcaagagaataatcatctcttacaccactagctatttccatcagattttggtttatcaccagtgtatgggcgacattagtgatccaatattactttgatggcttattgtccttctgatgtctggttcccgcaagaccaaacaatcccatcagactaacaatcagcaaacccaaaacagaagtaccgctttcagcatcatcaccggtctgcggtagcatatgcctccctgcatgatccgtttgcggtaatgaacctgtctgggttgtttgaccggcttgtgttggcttcgtttgtgttggcttcgtctgtgttggcttcgtctgtgttggcgtctgacccgatggtatactacctgtcgtctctccaccagtacttggcaaaatatgggagccagcggttgaccctgtggcactctgatcagccaaggatgtggcggaactaatggcagcagttgtagcgctggatgctacatcggcggcgctacttgccttagcatcgtcagacaaagcggcactggcagcgctagaagctaccgaatcatcagaagcagcagcactggcggcactgcttgcttgactttcagcgctcttagcactgcttgcagctgcacttgctgcatgagagtatatacccgcagcactactgttaccagcctttgcagcactggatgcggcactggccgcgctggacgcgacactcgcagcactgcttgatacaacatcctcactggaagcaatacttgcttgttcactagcatgacttgcagccgacgatgccgtcgaagcctcactttgtgcggcactagcggcactggatgcagtacttgctgcactggacgcaatacttacatctgactggatcccactatcacttgggtacctggacgcagcactggatgcggcacttgcttgacttgtagcactacttgcatggccagtcgcttcactggcactggagcctgcctgatgagcatatgaaccggcttcactggcactcgaacttgcagcactagcatacgcagatgttgcggttgatgcttgacccgcttcgctggcactggagcttgcgccacctcgtgtgccttgagctgccgctgaactagcagccgcgctcgcggcacttgaagctgcgccttccgcagcgctggcagctttgtcaaagcctgcagccgcactggcggcactagaagctaccgagtcatcggatgccgcggcactcgccgcttcgctggcaactgcttctgcacccttggcactgcttgctgcagcactcgctgcactcgagaatcctgctgcggctttgctatcaccagccttggtcgcactggctgcggcactcgcattactgttggccgtgctggccgcactgcttgccaccacatcggcacttgcagccgtcttcgcctgttcacttgcatcactggcagcactggaaccaaccgcagcagcactggttgcggcactcgcgttactgcttgcctttgctgcctcgcttgcagcctgactggcaagtgactgaatcccactatccttcggatagctggatgccgcactcgcagcggtgctggcatgttgggctgcactgccggactgaccgacagcgtcactggcgctggagcctgcctgatgagcatatgaaccggcttcactggcactcgaacttgcagcactagcatacgcagatgttgcggttgatgcttgacccgcttcgctggcactggagcttgcgccacctcgtgtgccttgagctgccgctgaactagcagccgcgctcgcggcacttgaagctgcgccttccgcagcgctggcagctttgtcaaagcctgcagccgcactggcggcactggaagctaccgagtcatcggatgccgcggcactcgccgcttcgctggcaactgcttctgcacccttggcactgcttgctgcggcactcgccgcactcgagaatcctgctgcggctttgctatcaccagccttggtcgcactggctgcggcactcgcattactgttggccgtgctggccgcactgcttgccaccacatcggcacttgcagccgtcttcgcctgttcacttgcatcactggcagcactggaaccaacggccgcggcgctggttgcggcactcgcgttactgcttgcctttgctgcctcgcttgcagcctgactggctagtgactgaatcccactatccttcggatagctggatgccgcactcgcagcggtgctggcatgttgggctgcactgccggactgaccgacagcgtcactggcgctggagcctgcctgatgagcatatgaaccggcttcactggcactcgaacttgcagcactagcatacgcagatgttgcagtcgatgcttgacccgcttcgctggcactggagcttgcgccacttgcgtaatcagttagagacttgatcttattcaaatcatcaagtgcttgacttcttgctgtagctgcagtcgcttgtttattcttggagtcgctttgagctgcactagcaacagcagctgcactacccgctgctgctgcatcactcactgcaaccttggcagcaacttgcgctgtcgataacgctgcgctcatggcagccgcagcggaacttgctgcagatgatgcagtggcatatcccgaactatcattagcagcagaagcggcactggcctcagaagcgtaggaatcataagcagcggctgcagagtttgctgatgcatcagcgttacttacggcagcagctgcagatgacgcttcactagccgcgctacttgccacgattgctgcggacgctgccgcactggaactagccgcagcagacttgctagctgccaaagcaatttgcgattgcttctcagcatcactggcgagagacttgatttccatattatcagcatgactgccagcaatcgattgcgcttcacttgcataactcgccgcatcactagcagcagcacttgtagcctttgcctgtgaagctgtgacatcagcagcactattggcgttgattaagctgccagctgcactggatgcctgctttggcgtttcggcatcgttgatcactaccgtcgctgttttcacaatgaatccagcactcgaaataacttcaaatgaagcattggcaggtaacgaaaccccagtcggcagttcgtaactccaattaccgtccttgtccgcctgtaccaaatattttgtactatcataggaattcgcagttaagctgccttctggaatcccctttaaacctgaaatcgttacataggctccggcagtggttttacctgtaagcgttgtggtttcatcagtaactggatttaccttaataaaattatcactggcactgacgaactccaagcttttgtcagtcgcaaacgtgtcggcaagtgctttcccggattgttcatcttctgctgtctcaccttcaaccgtagcggtatctgaagaagagccattcccttttagtgtatagatagcggacttatatggcccataggcattcccgtcatccggaatgattttcacatattgacctgttagcgtgccggtaccactgactttaaataaactgctgtctgcgtcatcgttatcggtaatcttaaaaagaacggatttcggcatatagatgttaatgttggcatcgtcaccgactttcaacaaatgcgcttcgcccgtgccaccgtcaatggttaagttggccgtagcatcctgtgcaaaactcagttgaccgtcatttgctacattaattgcattgacactctttgtccctgtacccgttacattaagatccaaagtgctgccacttgcaacgaagaagcctccggtacctttaatattgataaagccatagccaagtttaggcgcaccattttgagtgatcgtcatgtgcgatccttcgttgaggttgacagttccggtaccgtcaattcttaccgggatgtttccagttgcaccggtaatggataccgttgcattcttatcaacggttagattaccaccgtcttcaatatagattggtgcaaagccatctttcacaagtgcatttttattaaggataacggttgatccatccttaaactcaacgttacctccctgtgtatcaatcaatgcattcgtaccacgttcattcgatttgcttgcatccgtgcgttgtaagttaacggttgctcccttgtcaacaataaatgaaccgccatcatatacttcaacgttagtcccaccagtagttgtccccgtgtaagtagcgccaggcaaaacctctaaataactaatttgaaagttttgctggttgcctaagccttgggttgtctgggttgatccgtccagcggggaaacataactgcccactgactgaatctttgtattccccttaataaaggcttttgtataaatgccatacatcagttgtgcacctgtgtatgtgacattattgaacactaccgaatgatcgatgccgtctttcggcttactgcccttgatagtaaccgggccccaccaactgtaaccgtacatatttaaatcgttgatggtaaatgattcattctgactacttgtaggatcagcttcgaaatacttcttttgaaaatcaattgtgtggttattgccattaataattaggtttggccgataagcatacgattggcgatcaccactaacatccataacaaagtcggactgtacgttgatgacacttaccgttgaatcggccatggctgcatcaaactctgacgcggtgctgacatcggcgctagaagcatcgtttgataccgcttcattaactggagtttgaccttcagatgtatttgttgcagaggcactattggcgcttgcacttgttacactggcggcgctgttgccttcatttgcctgactcgtagtatctgaactaccacttgacgtgccgccaacaccctgactcgcacgaccatcgctggcatcaactgcactactgcttagagcgctggtcgctttttcgccgttactgccagcactggctaaactagtgcttttgatctggccactactttcaacgctagcactactttaagacgcactggctgcgttggcactactttgactgccgccaattttactattagtggtcgttgccacattagccgtgctcgctttggcttgaccatcgctcgcactgctgctggctgtagctacacttgcacttgctgatttcaggctatttgttccattttgaccactactggctcccgatgaaggcgcttcggtaaactctgaactgttgggcgcttgagcatcagctttaaccaaattcgtctgataggcggtccccaaaccgatgccgatgaagaataatggagcaattaaccatttcttctttgccttaaacatcttgaaacgctttttctccaccaaaacatttgctctatttatctttttcatacccaagatcctctcaataaataatgagcaacccacttgattttttacttgtatttaaaaatccggcttagaactgtttaaatagtttctcgtggtgcgatcatcccctttcctgagtacttgcaagcaaaagcgaaccgggagtcatctcaaaagaacgctgataatactgacttccatgcaccgatgaaatcagcttctgaatgttgttttgcagtacttaaagcaccagcttgtaatttgtgataaagccgattatcttgcaacacgaccaaaatcgccttgcctaactcgctaggcgtcatattaacaaccgccaccccattttgtctgttcactaacaggttatgcttcaagaagtggcatccgtatgcaaccactggtatgccatacgacattgcctcaagactattcataccgaaagcttctgacttcgccgcagaaacaaacagcgtcgtcttgtccaaaatatcctgattgtcattgctataggcaaccagatgaatcgcatcatcaagttttttcttgtggattctatcgcggatctcccggcgataggcctcgtctgaaaaataacctttgaggaacagttcagcatccggacgttctcggtgtacacgttcaaacgcatcaaccaaatccgtaatctgtttatctggaaaaagacgcccgatatacgccaatcgtggatgatcgggttgtattttcttggctttcggcgtctgtgcataagtatccggggcagccgcaatggttaagtgcggatattgagtctcaatcgctttaacttgatcatgcgtaggaaaaataacggtactaaacggatgctgctcgcttagtacctcgttgtaaatgacattaggtacgcgcttcttcccttctcctttcaagaacaggtcaccttcatgaataaaagcgagcttagcagttgcatggttaacttgcttgacggcagcatcaagcgttctgcgatctgaaatcatgattcccggattgcctttactaatttcattcaggaaaaaacggaacaggtcatcttcggaatcaaatacataatcatgtccttgataatgaaccaacttccacattgtcggtgcaagctgaccatttttattcatgtggataatctccaaaaccacatggcctttctgatccaaaaacttctgtgcagccacggttccatcgggattataattttgttccatagacttaaacccgcgccaatcccagaattcggttaactctttgtgatcaaagcgatcataataatcaatacttccaactaatccgaccgtctctggcatgacagtaatctttgcaagcgttcgacctaacagatcgatagttgtcgtattattgtcaatcccaacgacatgatatttcgtcaggggaatcgattcgagtaagcgtaacttctgttctttacgctcaaccccgacaacaccctgaaaataatcgtacatgttgatatatgcatctttgttaactcctgcacgcttggcatcccgatacaagaagcgattatagttccggagtagcagtttagattcaatgccattttgattgaaggctttcaggcgttgcagctgcgagaactcagtgccggaattaaatgtgaaaacattttcaccaaccatgtaaatcatttcgtcaccttcccctcactcttttgtgcatccattaaaactttgtgccatttcttccaaacattttcttcagaatatctgttagcagattcgtatgcattcgtactcatctgctgcatcttgtcacgatcggatagcaataactgaatcttctccgctaaggcatgaatatcgccatacggagtgacatacccattgatgccgtcttgcacgatttcgtttggaccgtagttaacgtcataggtcacgccgacaacaccatgcgaaatcgcctccagtaatgagagatcaaaaccttccatgatagaagttaagccaaaaatctgggcagtatcatacgcactttccagattttccgtgtagcctttaaaagtcacaaccccttccaatgaaagttcttggattgttttttcgatttttcgtttttcagcataatgattcgttgcatccgggtaatcatacaaatccagcgtcacttgcggtatttgtttgtggacgatggcaatggctcgaaccagatcattcagatttttttccggtgcaatcctagcaaccgcgatgactttgccgaatattcgattttccgacagaattcgctggcggtgaagcacgtcatccgataccacgccaacaggaacatggaaggactttttgatgtaagggaagcgtctttgaacatcagctgcctgctttttagttgcagaaacaaatgctgaatacttcgcaccattaactaatgcaaattcataattgttattcataatcgaatccattggccgttgcgcatcgccagcatgtgaattatgtaggtgcataatcgtgtaagcgggtttctctagatgaataagcgcttcatccgccaataaagaccgatcaaggataaagacattctggccagtttcattcatgtcattaataaaatgttcaaaaaacgcatcaatcgtgtcaaactgaaaaattttacctttgcgatctgtcagaatccacccagtctgcttaagcttgccatcttcatttttcttgttaaatgctctgattaccggacggccatccaccgttagccattcctcgttgccaaccttattgtctggggtataccactgaaccaatgatttaaatccgcgaacatcataaaattcaacttggtatagattctcaactccgtcaaacaattcgacagaaaccacctgtctagtgccgcgaacatagttgatccgcgcagccaatcgcccatcagctcgtgaaaccaacatacgattgtgctcgtaatcatcggaatattgaagatctttaagtcccaggtctacctgctccggtaacaaccggaccgcgtcaacatggcaggcgtgctgatagtaatcaaacatgttaacgaggtgatcatccgtaattcctgcattggcagtgttagtatgtagatcccgttcccaatcccgtagaagaaatacgtaaggttcaccatgcttatcaaataggcgcttgcgctttatctgcgcatgctcaatacccgatttgctggcaggcataccgaaattgatgaaatagttcactagcaatcactcctagactcaaaaataaacttatcgagaaaaattgtgttagttatgaaacgaattctgactattaattaaccttgtcccccggaagcgttatctatccaatataggtgctaacacgtcggccactcagaaccgtcactggctagaatttaactcataccctacactaatttctgactacttatacaatactagcattaaaaaatttgttaatatataaatacaatgaaatcgattccacttttgaattttcctcgagcatattgcaccatccccctttataatcagcgccatatcagccatccacaggttaaaaaaaattttcgaaaattattttccaaaaaccgattcatcaccaaaaaagcatgccaccataagctgttccttggtctacaaattttttcgcgccaaattccagttattgactcatgcttctgaccattaaaaaagactttatcacgccaaatgcgcaacaaagtcttttcaaagtttcgttatgatacaaaggcggtttttcacttgaaactcgtgcgggctagatcactgacgcagcgcccgggtcaccgtttgctcattgacaaacgtatacaggcctaaatcgccaagttcacgaccatacccggagttcttgaccccgccaaatggaagctcagcattgtaactttgactctgattggcaccgaccataccggtttcaatctgcgcagcgacttctgccgcatgattggtatcaccggcaaagactgctccgccaaggccataaggaacatcattagccaacgcaatcgcttcttcttcgctatgcaccttataaacgcaggcaaccgggccgaataattctgtccgatacgccggattgtccttgtcaatatccgttaaaatagtcggccggaagaaggcaccaggcaaatcaaccggtgtattgccgtaaacaactttggctccgtgttcaatggcagtatcaacctgaccttgcagcttatcttttgccttttgactgttcaacggacccacattgactgatggatcactcggatcgccaattttgacgtttttaaaacctttcttcaagccggcaacaaagtcatcgtagtatttatccaacacaataaaccgtttggagctggtgcaaacctgtccgcaattcatgaggcgagttttaatggcttctggaatcacgtgctcaagatcagccccgtccaagaccagaaaagcatccataccgcctaattccatcagcgacttcttcaaatacttacctgccaacgccgccacatgcgaacccgcaccttctgaacccgtcaagcagacaccggcaacgcgcggatctttaataaaggtctcggtatcatcatgcccgataagtgcgatttggaaagcacccttgtcagcgccgccagccagaactgctttttcaaattcaaggccgctagccggaacattgctggcaggtttaatgatcaccgcattccccaccataaagtttggtgcgaaaacacgcattaactggtagtaagggaagttccacggttcaacgccaaacacaataccactggcaacgtgattgaccaccgcagcccctgcagtactgttaagcggttgcggctgcaacaatgccggagcccgatcagcgtacatatccgcaatttcagcgcaaagttcaacttcgcctaacgcttcttcggtccgcttacccatttctttggtaataatagccgccatttcatcggcattgtcgcggaaataagcagcaaccgcatgcaatgttgcactacgcgtttcagggtcaagattacgctgctgcttgtaaaaagcatgccccgccgtcaacatctcactaatttgtgccgatgttgtgttcgcataagttttctccaacgtgttcgtgttcggatcaacggtttgataagccatttttgtaaacgctcccttcgtgtccttacttaatcatagcttattcagagggtagatgccaaccggataaattccaagacagcggatgaaccttcgacgacagattgcctggcaaattatcgtatcaacaagcaccgaataatccgctatcaacaagtcgtcgggctcaaatacccgttgcagcagctaactgaatatggtaaatggcaagcggttcagtgttttgtccgggcaaaatttcctgtaaaacgccgccactggcctcaatcgtcttgcggctcgcccaattagccgattttgccgtcacaatgacataaggttcccggcgttgctgataatagcctaacgcaaatttgagcaagtttttcgcataaccgtggccgcgctgagacggagccacatgatagccaaaatgcccaccggttctggctagcatcggtgtcatttcagtccggcagcgaacccgccccaagatgacgttttccgagttaaacatgaaaaaagcaaactgcggcactagctcgggtttttcgggattctgatcggcggttagtactgccaaccttgtcgtaaagtcggttgcaggcgtcaattcgcgaacaatattttgactgtaaggattttgctgatcgaaatttaaaacatcgcgccgaaactcattaaatgcatcctcatcattgggtcgaagcgaacggatcgtgaacgattccatagtaagacctcttttcgtaacttgacggttcagacttaatttaccgcaaaagaaaaagacccgctagtcatagcgagtcttaaaatattcaatgaatgttttagaagtctgttgggttaaccttgatgccaggtgccatcgttgaggtcaacgtcaaactcttgatgtaaatacctttggtgcttgctgggcgagccttcagcacaatatcattcattgctttgaagttttcaagcaacttgtcagcatcgaagctcttcttaccgattggggcatggatgataccagccttgtcaacacgataagcaacttgaccagccttgatgtcattaacagccttggccgtgtccatcgtaacagtaccggtcttcgggtttggcattaagcctttcgggccaagaatccgacctaaacgtccaacttgggccatcattggtggtgtcgcaacggcaacatcaaagtccaaccagccgtcctggatcttttgcacaagatcttcggcgccaacaatatcagcacctgcatcttcagcagccttagcctgatcgccttgggcaaaaacaataaccttcgacgttttaccagttccgtttggtagcacaacagcgccacggatctgctggtcagcctgctttggatcaacattcaatcgatatgcaacttcaacggtttcgtcgaactttgcaaagtcgattttcttaagcagattaactgcttcttcaggggtatactgcttggtcgcatcaacggccttagcagcctctaaatactttttaccttttttagccattctgggttttcctccttgcaaatgtggtcactgggagcattttactcccttccacctgattgcctcagttttcactgagaatccgaacagtgcggcctagtcttcgacttcgaagcccatggagcgagctgttccttcaaccatgcgcattgccgcttcaacatcggcagcgttaaggtcttgcatctttgtttcggcgatttccttaacctgagctttggttaccttagcaaccttcttcgtgttcggttcgccggaaccatgttcaacaccagcagctttcttcagtagaatagcagccggcggggtcttggttacgaaatcaaatgaacgatcttcataaaccgtgataacaaccgggataatcatgccagcctgatcagctgtccgtgcattgaaatccttggtgaaccccataatgttgataccggcttgcccaagtgcagggccaaccggaggagctggggttgctttcccagcaggaatttggagtttgacaatgtttgctacttttttagccacgagacatacctccttaagtccgtgatgtggttatgatggccagaatttttgacctcccacgcgtatgctgaaaacatactcgaatagattaccatgttggacgataaaaggcaagaagaaccggcacatccctgcgttttatctgttcccaaaaaccttcataaccacggtcgtccgcgctttaggtaaattcttttaacagtttcaaccaatatcaaatagacaagaataatgacggcagctccgggccagtaagtgactggtaaaataccgaaatcaaatgcctgatggaatggcgatagaatgatgaaaaggccaactaacaaagccatcatggttgacaagatgacaatagctgaggctggtgaccgccaaaatggtgtgtgacgagtacgtaacacatgaaccaccagcgactgcgtaaacaatccaaccacaaaccaacccgcttgaaatagatgctgcgccgacacactggcggcgtgagttccaacgccaagcccgaaccatagaaataggaaagtcgtgatatcaaaaatcgaacttagcggtccaaaagtcaatgtgtagcgcaataatcccttggctcgccatggtgtcggttgcgctaaggttgcttcatccacattgtcccatggaatcgtcatttgcgaggtatcataaatcagattttgaaccagcaattgaatggccagcatcggtaggaaaggtaaaaagatactcgccaccaacaccgaaaaagcattaccgaaattagacgcaatggtcattttaatgtacttcatagcgttagcataaacgcgacggccttctagaatcccatcttccaacaccagcaagcttttttctaacaaaataatgccgcttgcatctttggtaatatcggcagctgtatccacgctgatgctgacatccgcttcacgcaacgctgcagtatcattgatgccatcacccatgtatccgactgtgtgaccggccgcacgcatggttttaatgattctggctttttgcatcggacttagtttcacaaacaaatccgtggtctcaactgcctgtcgcaacgcgctatcatccatggcgtcaacgtcattaccggttgcaacaagctgattggcaattcctacttcctcagcaacatgctgcgtaataatggcgttatcgccggtcagaaccttaacccggacaccatgcgcgcctaacaacccaattgcttcttttgcatcgggtttggccggatcaagaaaacccagaaaaccagccaaaaccatatgctgttcatccgacggcgtataaatttcctgttgatggacgtcttgacgatatgccacgacaatcatgcgcataccttgaccactcatggccgcgttagtttgtttaagttttcggatccgctcaggtgtcagcggcagcacatcaccattgagttgcactcggtcacaaaccgccagcatttcttcaaaggcgccttttgtgatcatccattgatgcgcatcgttagcaacgacaaccgtcagtcggcggcgttcaaaatcaaacggaatctcatcaattttggtcagcccgcttggtaaatcggttaaaagatgctgatgctcacgggcataatccaccactgcagtatccatcaagttgtgccacccggtttgataattagcattcatatatgccatccgcaacactgccggatcggtttcgcccgtagcatcaacatagcgcatcacaacgacccggtcctcagtgatggtcccggttttgtccgtgaaaagcgtatcaattgcgccaagattttgaatggcgtgcagtcgtttcacaatgactttccgcttcgacatcgccaacgccccttttgccaggttactgttgacaatcatcggcagcatttccggtgtcagtccgaccgccaccgcgatggcaaaaaagaatgcctgggaccaatcgtgcttggtaataccgttaatgacaaagaccaccggcaccagcaccaacatcatgctaattaaaacccggctaatggcgcgcatcccttgctcaaaactggtcggcgccggcttatcgctaatttgactcgccatgtcgccaaaataagtcgcgtctcccgtttttagaataacggccgtccccgatccggaaattacatcagttcccataaaaacgagattaggagcatcaaacaagctttgttcatcgcttaaattcgccgcgcctgctttcttctctaccggcatcgcttcaccagtaaacgacgactgattgacaaataaatcatgagtcgcaactaaataggcatcagccgggatcatatcaccggtcgccagctgaacaatgtcaccaggcaccacttcatccatggggtgctctttggtttcaccggcacgtgtgatcgccgtggtattggcaatcaaggccgccaatgcatgactttccttttgagaacggtattcctgccaaaaatgaatggacaccgataagataatcatcaagcccatcattctggcgccgtcataatccgcagtcatggttgagactgcacacaacaatagcaatacccagacaaagggttcattgaatgcagcgaataaaattaaataccacgggcgcggatgttgggtaacaaccgtgttggggccgtcctgttcaagccgttctgctgcctcttgtgaagacaaacccgcttcttgcgtcttcaaagctgcaaaaatggcttgtggttcttgctggctgtaccgtgtcagtgcagcagttttctcctgagtcgaagcatcgcgcctcgatatggttttattgaacatcattatttgttatataaactgtggaagcatgccgctatgacacgaattaaagctttatatcgttcctcctcataaatttgacgtatgcatgtcgtctctagcaagcatccgcgagacacttactggtttcatcatacttggcaaggtttcagagcccatgttgcttaataacagctcatcaatacatttcgccattgagtttgttttgaccacatgagcaccttccacttaatgattgcactcatgtctgcgtgggtgccgcgtcgctattatccataaactgccattgtttcctcactccctcgttttcatgccttagccgaaaaaatataacggtctaaaacaattagctttactcaaagcttaacttgacggtaagatggttgtcaaaggtaactaaaaataactgctgtcagggaaacaaaaggcgcttgttggcatgaggtctaaccgcgccggctcgcgcttcgaccataacgcgctcaccagcccagaaacctgcgtgtaaggacctcgaacgcgacggccaagcccgggccatcacgcccgaggccgcttacactccggtttctaaccgggctggttcacgctcactttctataacgcgctccccggcgcagaagtctgcgtgtaaggaccttggtcgcaatggccaaagcccggccatcacgcccaaggccacttacactccgacttctaaccgcgccggctcgcgctcactatctttttggaggctaaacatgatttcttcagcattagctcaagccgcggctgttcgtgcaggtaccgtgacgagtggtgacttgattgacatgactgcaaaaaaattaaccacgcgcaatctgcaactgaatgcggtaacgtggacgaggtttgatgcggcaaagcatgaagccgcggcactcacggatactggtcagccttttttcggggtccctttgtttttgaagggactcggtcaaagcctcgcctgcgctccagaaacgggcggcagtcgcctttttaaaaatgccaaggcaacccgtacgaataactttgttcaggccttgcaaagactgggtttcatcattgtcggtcaaagtaatgtgccggaattcggatttaaaaacattaccgatgctgcactttacggaccggcgcgaaatccttggaatctggcctactcaccgggtggctcttccggcggtgctgcagcgttggttgccgcaggaattagcccgctcgcagccggttctgacggtggcggctctatccgcatccccgcttcattttctggactgatcgggttaaaaccaacgcgcggccgtgttcccaccggtcccgatgaatggcgcggctggcaaggcgcctccattaattttgccttgacccggacgatggcagataccgaagcgctcttacgcggtttagccactactcaattagccgcaccgtttattgccccaccactgcggcttgatcaagtcaacgacacgcgaccgttaagaatcgcttacacaacgcaatctcccgtgggcacaccggtcagcagcaccgccataactgccgtcgaaaaagctgtcgatgcgttgcgcgctgcagggcatacggtgaccgaagccgctccggatgtagacggtgttgcgctcatgcaggcttattatctgatgaatggtggcgaaacggctgccatgttccaagcctacaccgatcaaaccggtcggacggttacgcctaacgatatcgagttaatcacttgggccatttaccaagcagggttgcacaccaccgccgctgattacagccggtcattaggcatctgggatcgggccgctgaagcttacagtcgatttcatgaaacttacgacttgctgttaaccccgaccaccgccaaaaccgccccgcgcattgatgccgcgttacaatcaccagcgatcattgaaaaaatgcaccacgcagccgagcttgacccaagcgaacaacaaacgctgatctgggatttattcgaacccagtctcacctattcaccattcacgcaacaagcgaacttaaccggcgccccagccatcagcttgccgaccgctatttcagatgaaggcctgccactagggatccaatttaccgccgccaagggtcgtgaagatcaacttctacggatcggctattggtttgaacaacaccatcttttgaaaatgttgccagtagcggaataaggtcgccagccgcaagccaatcttcgcaagcgacaggatagcttttagttaaaaatacgttccactatcacagtatgcaaaaagccttggtccaatttttcggatcaaggctttttacttgccggtcttttcaaactaacgatcacgctaaccttgtttacttacttttcacctcagcaacgcctgctttgaagttgacatagcgtgccaacgcaaaaagatagtcagatagccggttgctatattgcaatgtgacggcgctcaaagtgtcatctttagtagctaattgatccaatgaccgttctgcgcgccgggccactgttctgccgtattgtaacgcggctgctagcggatgtccgcctggcaaaacaaacgctgtgatatggggaacggcggccatcatttgatcaatcgcatcttctagtgctttcacatgtgcttctgtgatcgtttggtgccgcggaaccgcaatatccgccagcagctcatataattcccgctgccgtgtttccaatgcctccgtaagccagttaaatcctggcattgcctgcgcttgagcagcaacatagccgagccacgaatcgagttcatcaagttcgcctagtgccacaatctgcggatcgtattttggcaccttcttaccgttaatctgtttggtcgcaccgtgatccccgacttttgtgtatagcttcatgactgcctcctgtcttcaaccctgatgagaaaagcgtttcaatccctgttgcaaaaccagcaccactatcggataaaacacgagatttccaatggcgtgataagtatcaaacaataaaccacttaaataataagcccaaaagccaagaccattcaaactaccaatgaccgccattcctaaactaacgatgaacccgtataagtagccaagcagaccggctatcccaatctgaagccaaagtgtgcgccgaatcagtggtatcaacgttacgataacttgaaccacgactaggcacatcgcataagcaacaatctgtggcaacgtccacaagccaaatcctaaaatcagatttgaaaccaccaaggtactcatggtcaaagcaatgccccaccgaattcccagtagcagcgttgtcaccatcaaaatatccgtgacgggctgaacattaggaatcggtactttaataatgcgcaaaaccgtacacaaggcggttaataaaccaagcaaagccaccgcccggacaggcgatggctttttggctgctactggcaacttcatttagtcacactcaagtcaaacacaactttatcatggttcttaaccggttgctgcgaggcaccttttttagccatcttgccattgatggtgtacagccagtatgttttcttggcaacattttgcttcttgccagcgatctcggtgatgaagcccttggaagccttgactttccagcccttcttcaaaccggtcataacaacagattttttaggttgcgtaattttcttattcgcaaatgccttaccgttttccttcagttgatacgtgaccacaatctgattgggtttgctgctgcttttggccgtactgctagcactgctgctgcacccggtaagaaccaacatcgcagtgaagaagacaaccagtgaccgtaaaactttctttaacatgaacctacatcctccgtatcgtttatttaatcgggcaagcaccgccagcacaatcggtttgatccactaattcgagatctttttgatcatgatcggcattttgagccgcaaaaaccgctgcaaccgaaccgtgaatctgttggcatttctgcttgtaagtctggacgtcaattggctcttttggtgcttgtttaaagcctgcgccaacgtatggcagcattgacgtggacttgatgacatgccgatattgtgataataagtcagcaatctggtcagcttcttcaggctggaaggtcacggtgcaactcaccgcattatcagaccagtacgtttgcaagaacgcttgggtggcaatttgttcggcaatcgaaaccgtgcctgccgaagcaaatgccggatcatccgcatgcgctgcacgaatcggaaattcaacgaccatcgtatttttagtgtaaacatccggttcaatgtgatagccgcatgccttcagtgccggcaatagcggatcattggcctggaaccgaatccgttgaatcaaataaccggcataatggaaatgcatgccttcggaaacacccgccaatttagccacagttccggatggtttaacggttgtgtgcttgcgcgacggttcgcatcccaaggcttcagaataagctttatccgcgttgaccaccgtacgataaagcccatcaaccgcttgtttaatttccggatcataaaccggtttctcaaccattttacccgtatgcggatcaacaaccggttcaaatccggaaacaactcgatgaccgaaatcatccaggaaccagtcttgaatcccggacatcgaaatgccgattcgccggttcttcttgataatatcgcgtgaaacctgccagtcgtagttgctaaaggtgacccgtttagcataacgcgcagctaacgtgaaggcctgttttagcttccaaccttgctgcacggccacaaccgggaatacttcaaataaattgcagggctcaccgttggccaaagaaatttcgccgcaaggatttgtcccttcgacatccggatcattggcggcattttcgccatcgacaatgcgtccatagcgccgggacaagtcgagattgacaatgcctggttcgccatttttggcaatcgccgtcgcaatcggtgcataggcttcaaactgggtatcaatcgcaacactgttattcgatgcccaacgatgatgatacagttgcttttgatcctgcttcatggtgataaacgcatcatcatcagctgaacctaacgacatttcggcagaacggcgaacattacctgcgacaacggttttaccaatcagattaccaatatcggttgcatcaaccgccgtcaaatgcttaccaactcgcgcattaagcacgttattgatatcctgcaacatttcaactaacggcatgggccctgaagccgtaccgccaaagccatgaatgcgcgcgccttttggtcgaatattggtaatgtctaataccaatttcgtttggccactaggattagttgcggcaaaatggtgatcaatcaccttggcattggccaaaacccagccttcgcgcgtatccggcaaaacataccgatcgttgcgttcggttgcatgggcttgttcccatgcttgtcgatcaaccgcgcccatcttaagtgaagcttcataactggcgctgcgccgatcaatgacaatcgtcaaatcaaccgcactggctactggtggcaacttggcgatattgtctttggtgacggaaaaaccaacaccgccgcctttcatcaattcatcaaacatgaaggaatatggcatcgaaacagcaggctgatcagcagaaaaatcggctggtacaatgtgtgaatcgccatatggttggggacgaatcgcaataaaccagcaattattcaatgcatcgccattacgcttttgataatccgttccggaaatccaaaggttacggccagatggcgtgcctgccaacccataaataagtttgaaaagattgcgcgcctctttttgcaaggccgttactactttaggatccggatccgcagtatgtaaacgcggatcaaggttaatattgccttcaacaacgcgcttgacggtttcatcccaattttcggttcgctcttcattcggcagccaccgcgcataggtccgcttgtaggttacccagccaagctccccccagtgcggcttaatttctttcttaacctcggcaatgaattcaggcgccaaggtgatcggtttcatcataacttgcatatccgtccctcccgtatacaagatatggtatagccaaacgaatctaatatcaagatatagattaatcaataacaattcgttaatgctggcgatgaccggtcaaacagagaatggcgggcttttaaaaaattcaggatgacattaaaaaagccagcgtcacatcacgctagcaagttatcagttatcaccataacgcgctccgatgcagaaacctgcgtgtaaggatcttggtcgcaatggtcaaagcccgaccatcacaaccaaggccacttacactccggtttctaagcagccctgttcacgctcactaaaacaccggtcccacataaggacgaacgagcacatgatctaaatccagtgttttcagctcggcaatatctgttacaaaacaagtaatggagccggcgagcatcaggttcattttcatgtccgtcagttgtagcgccacaattggcatgtggtgcgcatacgcatagccgatttcaaaggcggttcccggatcagggtcttcgccaatataatccaaaatcgcgaccatcaccgttgcttggtgcaagccgcgaatatcttcaccaaaaacctgtcgctgccaagctggtgaattttccgtcaaacctgctttgttagtatcatcgcgtggtgaaaaaataccgctaacggactcattttcatttaaggccgctaatacctgattcaaccgctttgtctgagcggggtcaaaaaaaggagcggcaagatagacttgggccatattttcctcctagcaagcattgcggcaactctattgtcgccaatgccttatttccggtgacagcaacttgcgggtaaaacataaggaaccttggccatcatggtcaaggttcctaagcaatgccaaaaataatgtgccgttgcttatcgcgcaaccgatatcttctgacaatagctaaaaatcgcgttgctgctgccataaatattcaacaatatcatgatcaacgaggcgattctcatggagcaaactgtgggctgcccgtggtccgcgaatgacgacctccgtatagtccttgatccgatccttcaccagataacgcaccgcaaagctgctgttaatcgcaacctcaccgtcatggcgacctccaagcatcaagtctccggcaatatttagccatcgcagatcagcaggaagattgtcaatggttcgctgaaattgctgataaataggggctgtgtgttccggtccctggcgcgtcaatgaccagtttagaatcggtgagcgctgagcaacttctaagtcattcataggcgcagcaatagtgactaggttggcgactggcacagctggtttgcttaataaatacaacactgccgtcacaccgcccattgagtgtccaatcagattaagctgactgaaagcttgttgcgcctgtaaagccgtaatcacgtgatttaatccgcgtaattgcgcagctgggcgtacggttttatcggtgaatagcacttgcaccgcagcatgatgattcaagttcaaccgaccacgcaaacgcaccctgccatcaggggcaacaatcgcgacaacatctttactcaagccataacgacgctgcatacgccacaacatatggccgaatgaataccgcgtacctaaatggccggggatgaacaaagtcggcgttgcatccatgactaatggcaccggcgcatatccgggacgacccagtaatataaagtctgctaaaccgcccgcaatcacaacagtgccaactgcaatcacgagccaaaaccagctgctcatgagccttgcctacagtttgtcgacttgatcaaaatccagttcagcagtgacttcgcggtcaaacatttcggtcacgactttgagcttcatcttgtctttatcaacagcggttactttaccatgcatcccggtaaaggccccatcgataatcgtaacgggttcgcccacatcaaactcaacatcctgatgccgtgtgctcatgcccattgaatgcaagacacttgcaacttcttcaggcaacaatggcgccggctttgaacctgcaccatgggaacccacgaaaccggtaacgccaggcgtgttccgcactacgaaccatgattgatccgtcatgaccatttcgactaacacgtaccccgggaaggtcttcttcatttcgatcttctctttgccgttcttttgctcgtgttcttcttcttccggaacaactacccggaaaatataatcatccatattcatactgctggtccgttgttcaaggtttgtcttcaccttattttcataaccagaataagtgtgcaagacataccaacgtttctctgctgatgtaactgtttcagccataatgttctccttttagtgttttgagtcaaaataaaaaaccgtcatcgaaggcggttttgcgctgctcatagtatagcaaaaataaagcagtttgtcaggtcttaatataagaaggcttggaagactgcattgataacccagtccacacccgcaaaatagatcgcaaaaataatggaagtcatgatgacggtaaacgtatcacgccgcgtctgctgggcagttggccaagtgacagctttcatttccgcgaaaacacttttgataaatttcatcattgcgctccttccattattacttggtttcttgatggaccgtcacgcggccacaatgtttacaaaacttttttaacgttaaccgttctgttcgttttgggttttcgggaacaaaataattccgttgcccacaaaccgaacaagctaaagcaactttctttactgacatcttgttccctccagtcacgtccaatatcttaccaagattacaaacagatagcaagcagaggttcgcgccggtaagtgtcaactttttctcggttctactctaattaagtgatttccgttactccgagctggctccgcggtggcgagggctggcgaccgcgcagctagagtggtgggcacgactgagcccgccaccgctccgccagctcttgctttctatcttaatattctaacaaggtggacccatcgcactgctaccaactaccatgatcgagtctgatattttggacccacaccatcagaagaaaataccaagccacaaggtcaacagcaaagcaccgccaacgatcattaaagattgaatcgtaaaaataaaagttttgtctttgcttggtgcttcagtgtaccgacgcgtgttttttttcaccaccggccaagtcaacataacgagtaaactccaccatggcaaactgcgggtcaaaacacctagcagtaacgcaacaaaggtacagaagggtatcaaccggtaccaacgtaaagctcgggttcggccaaggtaatatggcaatgtaaagcgctgatttttgatatcctgctccatatcagcaatgttatcggcaaacatgacagcagcattcaaaatgatcaccggtaaaacagcgatcaacagttgtaacagccagcctagattaagtgcaaatgtaaacgtgcggcggtcaagcgttaagtcaaggggtcccggtggtgtcatattgataaacaccgcgatcacgaaagtcccataaccttccacaaacccggccaacacctctcccagcggcaatcgtgatagaggaaccggcccgaatgtatataaaatggccacgccgacgccgaccacgccaatcactaacaagctcaggttggtacgcatgacaagaatgatgcctaaaaccacgctgatgagcaaaataaagatggtaagtgccaacatgccccaaggtgacaaatgctcgcggccgataatattttgcgactgctgataactgcgatctttggccttaaaataatcctgaacattgttgaatcctgtcacaaataaggcaatagccaattgagccgcagcgtatatgagactattgatccaagaaaactgatgaaatgcccaagcagcgtaactgattcccaacaccagcggcaacatactggcagccttagccggtaaccgaataaattctaaaaatagcggccacgtcagccgatgataagactgggtcatagcaccacccccattcccaaacccaaaaccagcaaaccgttttccaaaaccaggttgatcaccgcggtatgaaacgttcgctgtttgctgggatcacgaatgaaccgatgcacattgcgaatcaccaacggccaggctaactccaccaccaatgtccatatcggtagcgcgccaaaaatgacgcccaagatcaccgctaagaagccggcataagctaacaatgcgtaaacccgtggcgaccaccattgacccaaatacatcggcagcgtgtggcgatgattgcgctgatcttcctcaatatcagacatattattagccagcataatattggcaatggttgccatcggggtgatgcaggctaaccctaatgcaatgatggcgataaagtcaccacgtaaaacaaccgttggccactccaaatccaaggcaagcaagcgtcccggggcaatattgacataggttgcaataaccggaatgcctaatcccatgacaatcccggaaaaaatttcaccaagcggcaaacgagaaagcggtaatggcccccaagtatacaaaataccaatggcaaaacaagccatccccattaacagcaacagccaatccgtccgcacgaccaacacaacgcccagcaacgaagcaaccacaagcattaccagaatcaacttggcaaccattcccggatcaagctgagcccgaccaatgacattcacttcctgctgataatgagcatctttggctttttgataatccatcaaattattaagcgcagttgtcatcatatcgaaaatcaacattgcaataaaaaataaaagcgtattgagccaatcaaaggcgtgaaaataagtcactgcaaacaaagtgccaatcgcaaatggcaaaacacttgccagtttggtgcgaatttcaaccagttctaaaaatatcggtaacgacatctactctccccttttgtagtgagcgcgagccagcgcggttagaagtcggtcaagcttttattgtgaacccttaaccaacttactttaacttcgccagcgtataccccgagtccttcaacaacttaaacttatctttcaaccccgagctcacgtaaacttttttatctttggtaacaaaaatagcatcagcataattcaacttttcaatataggccatcccatcaactagccccttatcaaaagtcgcggttgacaaagcatccccatccacactctttttggtaataatcgaaacacccattaattcattatcaaatggatagccggttttgggattcatcaggtgcatataaaccttaccatcaactttaagatagcgttcatagatacccgaggtcacgatggttttattgctggcaggtaaggtcccgatggccgtcccacgaggcttcttaggatcctgaataccgacactccaatcctttttagaacttttaggacttttgcccatgacaaaaatattgccgcctaagtcaataatagcagtcgttacatgctgtttcttcaacgttttcacgacttcatcggtaataaagcctttagcaataccacctagatcaattgccatgccctttttcttaagatataccgtctgttgtttcttattgagaacaacatcttgatagtgaaccaatggcagcttggcatcaatttcactttgcgccggtttgcgcgcatcggcaaagccaatatgccacaaactcgtaatcggcccaattgccaagtcaaacgaaccattcgaattttcactataatgcttggccgcttcaatcacccgataaacacttggggtcacgtgtacgggtttcatccctgcatttttattcacggcatcgacttcggagcctttttggttaaccgtcagttcatcggccaactgctgaacgcgggaaaaagcagcatctagtgctccctgtttccccttgtcataaatcttaatcgtaacaaccgtccccatcagaaactgagtatccgaataaggatcgcccgaaaccaattcccgtttagctgtcgtctgactcgaacagcccgtcgccaccagtgccaaaagcatcaggataacgacaatcaatcgctttttcatgtacaacctgctatataaaatgtggaagaatgtctctttgacaccaataaaggttctatatatttcctttcttgattgacattcagcatctcatttagtcccgttaacagcggtattcccactctgaaataattcatcatgacagtgaccgcctcttgaacttttagggtatagcctacccatgtacttttgatttcgcataatcgatcaggttatcaactgcattttcatcacgtcgcatcttggctccgcattggtagcaaatgtaatcatcatgtccggtgtggtatttgacattaccgtgcaaagtaagtttctcttcaccggttttgatataaccacatctagaacaccgttgcgtactcggaaacattggatcggcaagaattaaagtactgccgtgccaatccgctttgtattgcatcatgattttgaatttaccaaacattgaacgatgcaggtttttagcaagacgacgattcatgcgcatgtgctgattatccaagtcttctatcccaattagatcgtgatcaacaactagcttggtcgtaaatttgtttaacaaatccatttgtatccgttcaacgcgttgatagtttcgcttcaacttggttctcgttgcgcgataggccgccgaattaaagtgctttggatttgttgttcgcttacgggcaagctgtttttggtagtgagtgatacgagcgtaaagtgctggtagcgaagcaggtagtgttggctgaatggcataacctgatggggtcttgtagtcgaacttgcctacattgacgtcaacggcagtaacccgttgagtgggtcgcttttcaaccaggactgcaacttcaatagacaacgctgcatagtaaccatctgcgtcttgaacgatgcaaacctgcttgatttcaccctgccatcgtggctgttcagccattttaatgtcataccagagtttggtgccacgtggctgatccaaacgaagcttgccattgactatctgagcacgatccgttttaaaagttttacgtgagcgctttttcgacttccacttaggcttgtcatgattgggcattttaggattcaaatagtttgcccacgccttacttaaatcattcacggcaagctgtaaaacgcgcgccgatcgttcaaactgccaatctgctttgttcgcaaccagttcatcacgaacttttcgctcattaggccgtatcgacttatccatcatgactaaagaggcgtcatacatgtcattccagatttccagcccttggttccaaacgaaacggcgataatcaaacaatttttctaattctttacgcatcgttgcattgggataaagtttgatcttatgcgttttaatcaaaagtgttcacctcccttcaagttaactaaaggacttacttcaaaaatggatcgtcttcaagctttccttgtattgacgtaagccggataaccgacgcgaaaatacgtgaatcatactaattaagtcttcagttagctctccctgaggtgatagaccaggatgattcaaccccacaagctgtgtggttgaatctttggggtttggcgctcaaaccaatcatagccaaaacgcacgcaactcgtcgatgtttctttaattcatcagcatgaccgatataagccaagtattgatgctcggtataataacatcaattaggtggtgttctgcgagctttgagctttccagacttatcccactgttgcagttgcaccgagacatttagccatttcgtttggtctgagcatatgagcatcttccacttaattatcgtgctcataacataccatgttacgctacattgttacatatatttgtctgctgttaatcacctccaaaaagtgtgagcgcgagccggcgcgcttagaaaccggagcataagtggccttggacgtgatgaccgggctttggtcattgcgtccaaggtccttatgtgcaggtttctgcgccggggagcgcgttatagtgagctgagcgtgagccagcgcgcttagagatcggagtgtaagtggccttggacgtgatggccgggctttggccattgcgtccaaggcccttacacgcagatctctgcgctggcgaacgctttatgcaccggtgagcatcttgaaccgaaagcaagccgacacactagccaagtgccacatcgtttactgactaaaacggttacagcaccattataccgggcattatgagcataagaaaagaactcgctcagaaaaattattccaaacaagttcttgcttagttaacccgcgctaataacgcacattaacttcttttcaagatcacgccattacttgtaaacaatattgtcgacttcgatcttgttggtattaccattttgagcagcgttaactaactgatcagcatacaagatgaaggtatcggaactgtgggttgcaccggaaaccacatcaaccttggctggtgactgcttagcaaccagtgacttgttcagttctgggatgtattccttcgggccaaccttgttcactttcttcatgttagcttcgtatttcgtatcctgagtcttggacttaccgtctttattgacgttgtcgtagttgctttcggtaatcttaccgtctttaaccgtgatggagaaggttacccgatagccgttgaagtagttcttttcttcaagcgtgtaagtaccatctttcatcttgccagtgttattgacttcaattggcttggtgtccccagcctgagccgcctgaactaattgttgggcgtaattcttaaaggtcatactggaatcggtcgcaccggaaataacatcgatagcgccgacattggttccattcttcttaaaggacttgtttaattcaggaatgtattcctttggtccaaccttgaccttagccttcatggccttttcatagctggcgtctttggtcttggatttgccattcttatcaacgtaatcatacttagtagaagtaatcttcccgtctttgaccgtcatcgccatttcaaccttatagccatggtcatagccggtttcattcagcttgtaagtaccatccttcaacgggccacctgcaacctgcttttgggttgatgacttcttgaccactttactgctggaagccttgctgctggatgaatttttgctgcttgaactactgctgcatgcacttaaaaccaaagtggacagtgcaacaacggctgtccccgtcacaactttacttaacttcatgacatttaccccttttgcagttcataactgcgatattgtgttttcaatcacatatttagtttagctagtcaaatcaaaaaaatcaaccaaacacgggtattataagcgctttctcattttttaatcgtcctttacgaagcgtatttttgtgtcattttacacaaaaatgtacggctttagaaaaagagagcgcgaacgttagacattacgtaattttaaaggctataatggcttagatacatactttgtaagagtatgggtaaagcaaatggtaaggagtgttatgcatggcgaaaaccaatatcgtcgtggttggcgcggggtttgccggggtctatgcgacaaagcacctggccaagcactacaaacgtaacaaagacgtgacgatcacgctgatcgatcgccactcgtacttcacttatgtcaccgaactgcacgaaatcgccgcggatcgtgtcccagaagacgcaatccaatacgatttacagcggttgttcaatcgacgtaagaatgtcaagctggtcaccgataatgtgactgggattgaccgcgacaagaaggaagttgtcactgaaaacggacgcttcccttatgattatgtgatcttgggaattggatcacaaccgaacgactttgggacgcctggcgttgccgaacacggtttcaccttgggtaagtgggaagacgcgattcggctaaagcgccacattgaagacgttgttcggcgcggttccgaagagcacgatccggctaaacgcaaagcccttttgtctatcgtcattgtcggttctggcttcactggtaccgaaacgattggtgaattacgtgactggcgcgataccttagccaaacagtacaagctagatccgaacgaaattcaatttagcttgatggaaatggcgccaacgatcatgaatatgctagatcgttcagacgcgaacaaagccgaacgttacatggaaaaacgcggcatcaaggtcatgaagaataccggcgttgtcggcgttcacgcagatcacgttgatctaaaagacggctccacgttcccaacatgcaccttagtctggacggccggggttaaagcaactgaccaagcgaaagatttcggcttgaaacaaggacgtgccggccgaatcttagtcaaaaacaacatggaatcgcaagacgatccaagcatctatgttgtcggcgatgtatcgttagttgatcaagacggcaccggcaagggccagccgcaaatcgttcaaggcgctgaggcaactgcccacaccgcgttgacgaacattgaagccaagttggaaaataaggaacaggttgaatataaagccaactattccggatttatggtcagcttgggttcaaaatatggtgttgccaatatcatgggctggctgcacctttccggtttctttgcgatgttgatgaaacatttagtcaacatgctctacttcgttcagatctattccggttattatttattcgagtacttcatgcacgaatttttccggacccgcaatggccgcaacatgttccgcggacatctttcccgtcaaggcaatgttttatggacactgcctgcccgtctcacattaggcgctatgtggttgattgattgctggccgaagattcaaggtaaagagtcatggttcattgacaagctccggttgccatttagctggttacaaccggctgctaccagtggtgcctctgctgctggcgctgatgcaaccagtgctgcttccggggccgctgccggtgctgccaaagcaaccaagaccgtcttctccctttcatatcagtatggtaatgatccgatgatggtctttgacaagatgccaaactggtactacagcattaccaagaccttgattcctaatcagcaagttgccttcttcatgcaaaaggccatgacgattatggaaattctgattgggcttgcgcttgttgccggtttattcacctggttgacctctgctgctacgatcgcttttgtcggcgtcttctgcctcagtggtatgttctactgggttaacatttggatgatcccgatggcctttgcctgcatgaacggttccggccgcgcatttgggctcgataaatgggttgtcccttatctccagaaagtctttggcaaatggcgctatggaacaccgcgatctctttacggtaccgatgcactcaaataattgtctacacaaaaggctctgggtggacttacctagagtcttttttcaagagcgggaagctgctgcggtctcttttatcggccacgactgctccccgtccttcgtgttcacatcatcgttttgaagtcatgaacttgaacgcgattcaatttcactagattggaggctcacaatgaaacggccaaatacctttaaacgttatcttaagatgattcgcccatttgactggatcattgttggcggcctgtttatcgcagcgttcattccgtatcttattttcggcattcatgagaatcagcagcaagcaaccgcctcgcaacaggtattaacagccgtggtgacccatgacggccatgaagtttatcgcaagcgactaaccggtcatactgggaccagccacttcacctatcgtgataaagacggtgactggaataagattgaagtcaaaggcgcgggaatcgcgattacggaagctaactgtcaggatcaggtctgcgttcgccgcggtcggattacgaaacccggtcaaacaattgtctgcctgccgcataagctactcattgcgattaagtcaaataaaggcgatagcaacacgggaggtatggtgaccgaatgagtgtttataaagccgaccgtacccggcagtatatctatattgccttactctgcgctcaaggcgtcattatcggcctactcgagcgtatgatcccgtttccctttgcctttgcgcctggtgccaaattgggcctggccaatttaatcacgatcatttcattgttcacgatgtcaattcccgacagctttattctgatgtgcttgcgactgctgctcaccacactacttggcggcaccttgtcaacctttctttacagtggtgctggtgcggttttatcgtggtttggcatgttactcattaaacaattaggtgaaaaacgtgtcagtatgatcggtatttctgcagcaggtggcattttgcataatgtcggccagctcttgatggcatccttcatcgcccaaagctggaccgtcatgctctatttaccgattctcgcgtttatgggcattctggcgggcattgcggttgggattgctgctaattttctttttgaacacatcgatatcttacgacgactccgctatgatcgcaccaagcgtcgtaaaaaaggagctacacatgaaaattcatcccatgtggcatgaatacccgacgttggcgccggagcttgcttcagcgctaacgttgattgaaaaacagatcacaaccaacaatacacctgtggccaaggcgatcatggaaatgattaatggcggtggcaaattgttacggccggcgtactgtctgcttttctcccggtttcaagacacggatcgcgagaaaatgattgcactggcggccgccattgagacgcttcataccgccactttgatccacgacgacattatcgataaatctccaacccgccgcaatcaggtgacgattcaaaaacaattcggcccggacacagcagtttatgctggcgattatctctttgttgtctgcttcaagctgttggcacattacgcctcaagcctccgcagcattcaacaagacagcggcagcatggagaaaatcttaaaaggcgaactggatcagatggccacacgctaccaaacccaaatcaccattaatgactatctcaagcaggtttccggaaaaaccggccagctctttgcgttaagctgttttgtcggtgcctacgaaagcggcggaacaacgaactttgccaaaacggccgaaaaaatcggcatgaacattggcatcgccttccaattgctagacgacattctcgattacactagcgatggcgaaactttgggcaaaccggtttacgaagatgtgcgcagcggcgtctactcagcaccactcattttggccatgcagcgcgatcgccaagcctttttgccgctgttagcgaaaaaagaacacattagcgataccgagatgattcaactgcgcgatcttgtcatcaagtatgaaggtgtcaagcaggcctacactatggcgcaacaacgtactgaactggcgactgccggtttgcagaagttgcctgccggcgctgcacgagacgatttaatccgtttgacggagagccttttgaagcgcaaatcttaattcgtattaaccggatcttaagcaaccagcagaaattgagctggttgcttttttgttaatgcagatgtacaacaaatcctctaactcctagatcgctatcaggttcgatttttcttactctcgattaatgaccattaacttttcatttttgatctgtttatctgcccatggtctttacggcgtcttgtcgatatgtagcccattttgatgaaaaatctcttcgcttcatgagaaaattccacgactttttcgctttcacaattgttggaatttgttatttaaagtcgaacttccatctgtgaaaaatcacctaaataatcaagttagtacaaaagtctcattcgataaatccgctttcaatgggaacgaaaacagcttactataggttcacaattttaaatcctggaagtcagtagtctattttttaatagtgggtaatcgttatggaaaataaagctaaactctttaattccggcaagataattgtcagtcatatcgttttccccttggttctagctattgcggttggcatcaccacttctggatcatttgtttaccaagccgttaatcatgaagaacccgttgtcgtccaggctgcttcatatcccactcctgcaaagcgcggtatcaccccatatggattgggtaatgatacggtttacgtttactactcagcctcacaaatggctgcagttaaagcggcttcaaacacccatgcaaatgctagactagcttttgcggctgcttttggcgccataaatcaatacgcagggcttctggcaacggccgcattgattcgaacaaacacccaattcaataactttagagaggcgatcaattcggctatttctaaaaagaaaggcttgcagcttcagtacaaaacaactttcgatgatggtaataacagcgctacctggggagcatcatttgttgttaagtaattagcatttcccttaaatcgaccccatgcaatgtacattgctgaattgaaggaacaatcagctcatctgctggttgtttttttgcgttccacgaagcatagttatccatagagcgttcaaccattctcaacccaggaaagtgtgagtgacatgaccaccattgccgttttttcagatatccatggcaacttagcagcgttagaagccgtgtatgcagatgcgattcaacatggcgctgaaacttattggttcttaggtgatctttttgggcccggaccagacgttcagccattgtgggaagaattacaaaccatcaatccgacaatcaaaatccggggcaactgggaagacttcttgatcaccacatggtcaggtagagatcgtctatctcccatgcaaaagaaaattgaagcttatattttgaaccacctgcatgatccggccaaaatttgcgccacccttgccagttggccgcttcaccaagaagtgacggttaatggggtgcaaattgggctctcacaccatcttcccgccaataacagcggggatatgctctcagtccgtgctgaaggttccgcattatcggcattattcagtggaccccgtagtacccttgacttggctatctatgcccacattcaccatcccacaatgcggtatgtcgacttaagcatgccgacccaaatcgctgatgcctttgattatgccaaagccgatgaacgccttgttttgaaccttggctcagtcggtttacctttcgacaaaccaactcgtcggtatcaagagtggcgcgctgagtatctcttattggaagtgactgacgacggcgcaatcaatccgcagtttcgccgaatttcttatgatctgcagcgagaattcaagcaggcgcaggcaatggacatgccgtttgctgagaattatcggcataatttttatatttaagcgggggaggtttgctgtgcatatttttctgcttttgttaggattttagtcggcccaacatttaaaagattcagtatactgatatacattgtaactggatggcatagagactgtttacaagcaaaaaaagtcccataaaattgggactttctgtacttcaaacactcctattaaattgttaaggctgatgctattagttgatttatcgcatatctggagaaaatatcctgttaatatcgtatggaagccttcactactctgacctatctttaaaataaacgctccctatgagtacagcaatcattagataaccagttaatttaaaatattgcgtccaataaagctcacccagaaaaagaagatcataaccaatattaaagagcatcaacgccaaccatagtaaaaatcctccaagatatgtcttggctttattcttaacgtttaccaccccagaccgcattgtacggcataccatgccaatacggttgccataacagctgcattacgtttaataccctgagctgctactttagcaacgatagcctttgctgcttccaaccagagctttttgtcaatataagccacgatagtattgacattgaccatgcttcggatttcctcaccgagttttcccagcatgcaatttccaatatcggctagatcgcgttgaacaattcgatgctccgttggaaaaatacgagattcattctcagagataccgataaacctttctgtagcctgaatttcatcttttccatatttggcaatgagataatcaatgttaagattttcaatatcgccatctacaaacatcttttctagttccttggcgatggcttgctcttttggcgttgccgagtttacagtaatctcgtctgctttagttgctgcattgaccggtttggctccggttagcattagactaacaaacaatgtcgttgtgaatatcgctagcaatgcaagaaatttaggtgttcttttccacttcgactgaaattccatgtgaatccccccatctgttaagcgagttactcgctttttttgtcaacatccgccataatttatccaggaacaataataacgtcatcacccaccggataagtgtcattcaggatctctgtcaaatccggcacacggatttccccctttctcctccaacctccttcgacatttacactgataatttaatcaaacttcagctaaaaaaattcaaaagtcgagtattttctacatgagaggtgaagaaatgtttgctgatcaatttacttgtggtaacttatttcgccaaattcgtgaacgtcgtcatcttaaaatcgccgatgtacaaggacccttacacaagacttcagtttctttctttgagactaaagatgccaacatccgtctttttagcctgatggagatcttgaagccaacaatgacagaaccccaggaattctttgagttaattgatcaaacgcatagccaattgcgtcgcttttttagagagctcagtaccttatatgaaagtctggatttagagggcttacaaatgctcttgaccgactatcatgaaattaaacgatctgaaacaccacagtatatgctcaagctaatcgttatgtcttgtattgctaaaattaaggaacaaagcccagttttctcggctgaggatgaagagtgcatccagcagtttttgttaacagaagggcgttggttccattttgagtatctggtatatgccaatttgtgccactcactctccaatcgcatcaatgaccgcttacttcgccatatggtcaccaaatatcaagaatttcacctatctcggtacgatgaggcttttgttggtgctttttataatatttccgcgaggtacttaaaagatgccgattatgaccgtgccttatcaatgctagatatagttgccgactttcctgtcaaaaatacagccctgtatctgcggcatcatgtggcattcatccggctagctgtgccgatcttaaagtaccaagatcaggacgccaaaaagaaactagctgccttactgatggccacagagatcattgacccgaagttatataagacgaatatggcgtggatgaagtctctgaatttagatcccgaggcaatcttaaataacatcacctgaagaagtgctgggtccccatggaagaggagaacgattaacctagtattctaaggtggaatatttgatgttagcctaggattaaacagtttgcaaaaagcagcaagtccacccgtcttagcacagacggggcgaacttgctgctttgttaatttcatttattcaaggttgcacatcccaaacaaagtcaaaaaatgtatagcgctaaatctcattgattcactaaggttccaacataccaagttgtccaaataagcaacaaagacagtacgccgaccaggacaaatcgtttcaaactaaactttttatcaggaaccagccgtccgtaccctatataaccggccatggcaagcgttaatacgattaacactcgatgcaaaccttcaagaaatgtcataattttttatgattaatctatgcctctgccctttgtcaaactcaactagactaattcactcgcatttttaatctttaacaataccgaatccaagccggctttacacgattatccgtttcacattcaacaaatctttatgatcgtaaatcacactcacgctttttgaaatatcagcctaaactcatccgccaacgaaagcggcgcaacactatatggcacgtcatgagtcacaagtcctaaaacaagtttttcacgtgttgcctcatccaattttgccaaatcaataagcacctgatcacgatcaatatctaatatcgcatccgcactaacatcggttaacagctgaggtgtctgccgcattttcaaaaagtttggttggctctcatgcatattgatttgtttgacaatcttgcccgcccgcagaaaaagaatgcgatcagccaagctttgcaggttgtccagtaaatgcgagaccatgatgacgagcttgccattttctcgcagttgctgaatttgacccgagatcagcgcaacattttccgggtcaaggccgttcatggcttcatccagtaacatgatcggcgtatccgaagccacgaccattgcaaaacataatcgctgtttcattccgagcgaataggtgctgactttttgggtgatataactgcgcattttcaaaccatcgactaaggcatcgagcgtgatctgactctgccacatgtttcggtacaatttcaaatgttcatagccatttaactcaccaaaaagctcgctttctaaagggaatgcacaaattttttgatgaatcgccttaatcgcttgattgctttcgtaacgcagcccgtccacctctacatagccacggtcaggctttagattattcatgatgacattcaaaagcgtggttttacctgtgccattcggagccacaagaccgacaatttctttctgatttaaagtgagcgtgatgtcatctaagacctgctttttgttggcaaaggacaatccaatatcatttagctttagcatgatgccacctctctctttttcgggtgccgtttgtgagccaggcaaaatataatgacttcaagtacaattatcacgctcagaatcatgatcaacccgaacacgaaggtcatttgtgtcgtctcatacctgaagttttgaaagcccaccaccaaccggccgatattgaagtaactcggcagcaagtataacgagttgtgattaatggcgactaagccgggtagaaaataaagactttcgctaactagcaacaggattgtcaccgccaaactggcaaactcacttttcaagattaactgtaagacaacctgcagacgaatgatcagccatacgcttaacagtaaaagaacaagggcttccccgataaactggcctagcgaaattgtgctgaaagtgagcccttcatacaccggtatcggtaaggacagactgccaattccgaacttgatcatgttaaacggtaataagatggccaaaaagccaagtaacaagccgccactcattagtaacgctgacaaagatttgtcattgagcatggcccaagttgttaacgggaagtttttcaaaatcgattgtttcttgcgatctcttgtcactaaatccgtactgatcatcgccgtcaaaagcaataacgacaacgccagtccataaaagaacgcgcgttgcagctgctgtaaggctgtttgttgattaatcaccgctgccgtgacgttattgtttgccatatttgcatattgacgcaaccgagtccgcgcctctaaattccaataatggccattacggttctgattgcctgaacctgcatcgcggaccacattcggatcactataatattgcagcggataactaagccacggctgcccttgtagcactaagcgatcagtaagcgctaattcgtcagccattgatgctgctacccgattgtatttgccttgcccagccgctttcaactgcgcgcgttcagctttcataaactgaggaacataggtaccagcgttggcaatggtcggatagttaggaaatgccggattgaaggatttcatgaattttgcatttttctggtacttagcggtcacctcctggcgtgaaaagttttccaaagtgctatttgcaggtaagtattgatagcagagccaaaaactccatagcaaaaaaattaagcacgcgccccaatttttcttactgaggagattttgtttgatttgaaaggctatgtatgaacgattacgactcattttttgcacgcccccaccttgaaatcacgaataaaatacccgtcagccagattaacatcatccccaaacctgtcacccaaccgatgggcagatgatcgtttattagaaaatggcctgaatacacattagcaatgcttaaataaggtagcggtgttaaatagaacactgctggcagcgatggactgaatgtcacgatgattattacggtaatcaaagcaaggagcgttgcatagaaatttccgatcagtcgattcaaccaaatggctacgaccgacatcaatactgtgagcacaactgcatagaccgcaatcagtaaaccggcaagccaactgggaaccgtggtgatcttgtttatcaaggtaaaagcggttggatagttccagtccccgaaaccgataacgattcctaaaagtattaatcccacaactggcagaaccaaaaacaatccgatactcaattgaaagtttgctttgacgtgggccgccattttaccaagaaaatgaaccggcatgttcctcaaaatactttggtgctcaagttctactaaccatgaatctccgactaaataggcgattaaaaaaggtgcgcacactgcgatgacctgaaataataaggcgccatagtcactggcagtcttgatggcaacccgcggcgaaccttgaacttgttgtaactttctggcaaccgcgatcttcccggtcacggcttctttggttgggattaatagtccactagcaccggcaaaatcaagtgaataacttttaagttgtgcctgtgccaattcgacctgcccattaagaatcatgccggcatcatggacgagtaagccactatcaatcttgccggttcctgaaagttgctcattcagcgcctgcaccatttttccttgtttgctggttttcgaatagctttgggcatcatagcgtaaataactcgattgcaccgactgttgaatcctaaatgtctcaatcttcaaatcggcaatctgctgaaatttagcaacccaaaacaagccaatcactagaaaaaccataaatagttcgcctaccagatttttctgattcagcatcacttgcttttgaaagaaggcgcttagctgtttcatcttaaatgcctctctgttcacccatttttgctttctctggtcaaaactttactcaaagtgaaattctgtgagttgctttaacatactgaatcaataggtccacatattttgagtatattgataaaatatgagcccagcaaaaaccagctatttctttactagttcataccttctatcctctttatccattgattagtacatgatgagttttacattacattaaaatgaggccgccatcaagtaagagctcaaattaatcgtgcagcacgtccgccataatgtgctgcacggcgaggaagtctgcgtgtaaagaccttggacgcgtgttttcttttatgcccataacgcgctccccggcgcagggatctgcatgtaaggacctcaggcgcaatggccaagaccgggccatcacgcctgaggccacttacactccgatccctaaccgcgccggctcgcgcttaccaaaaaagccaaagcaccgcagccttcaaaaagactgggtaccttggcttattaaacctgcatcaatgagtgtgaacttttgcagcgatttgtttgccaaaatctgtttgatcaaaatgatcgataatgtccttaagctcagcataccgcagactagcgccgaacaacggacttcccggttcggtcataataccgtctgctaatcgattgtggacaacagtgtcaaagcccattcgatcaacaaaagccgctacttgatcaacagccgcgggatcatcgccggtcacaaacagcgccttgcgttttgaattccctttaggccgcgcttcttcttgcaggttatgatagcccatatgattgaaggttttgacaattttggcacctttaaaataggcttgaacctgttcactcgaagtggtcgttggatctaacacttcttcgcgaataccgtctgtttcccaccagtaattcatcgcgtcaatgaccaaatgacctttgagtaagtctgcatcaatatttttataccggcttaacgggattgctaaaatgatcaagtcactgttagccaccacctcggcattttcggaagcaatcgcgccggggacgagggttttgatggttaaggcgatttttttgactgtgcctgagccggaaattcggacagtataaccggcatctaaggccaaacccgcaagaacgatgccgactttaccagcaccaagaatgcctatacgttgaatcgccattatttcaccgccgccttttctgctagaatttctttaacccgcgggatgactttcgtgccatacaactcaatcatgcgttcacgctgagccgcagtttggttgccggcaccgtaaacaaggtcaaagcggcccaaatccagcagatcgattgtttctgccatgcgccgcgccacggtttccggattgccgacataaaaagagcccactttagtttcaccatcgaactgttcgcgactcatcggtgcccagccgcgagttaagccgatgcggtcaaaattggctttgatattcttgaaggcgacttcaattgcttcatcttcgtcatctgcaataaagccatgagagtggacggcgattggaaattcaggtttgccgagttcctttgcggcagcatggtacagctgaatatatggcttaaaccgactcgcctgaccgccaataatcgcgatgatcactttatagccgaagttaaccgctcgaatgacagattccggtgagccgccgataccaatgtatgtctccagtttgccgttttctgttttgggataaacttcctgattcttcaaagcagcgcggaattttcctgaccaggtcactgctttttcattgcgcaaggcatcgtacaagccaagtttttcgttgaacaagtcgtcatagtcggtcaaatcgtagccaaataacgggaaggattcggtgaatgatccgcggcctaacattacttgcgcgcgcccgtcagacaacgcatctaaagttgcaaagcgctcataaacccggaccggatcatcggaactgagcaccgtgaccgccgtagcaagcttaatttgcttggtcactgtcgaaatcgctgccaaaaccgtttccggacttgaaacgctataatccgggcgatgatgttcgcccactccgaaaacctgaatgcctaattcgtcagccagttgaccttcccgcacaatctgtcgaatcgaggccgccgccgtttgtaaactgccatcttcattcgccacaatgtcaccaaacgtctccagaccaaactgtaaatgctcaatgtctaccatcaaaaaagcctcccaaacgataatacttactttttgtaagttgataatcgtatcatagccttttttctggcgggtggcaagctttcacacagatattcatacgagaatacgccaattcatttatccagagacgcaaaaaagtccgatcatcgtgcgacggtcataagccaatattgacaatgacccgctgcgtaaccggactttttaaatgaagtcacatctgaagacttattcttttggtttcggccgacgttccaagtggcgccgcattttatcgagcaagaagagttgatcattattccatgggctattacggcgagctagatgcgcggcgtaactagacgtatcatggttaaattcacgttccgagcgttgcacttccttgagaaagtcgcgcgaactgatgcgtagagcgccgcgggaaaaaaccgtccactgctctgcttgatcactggtgaccacgaccagctgcaccagcggcgagttcatctcctgagccagtcgttcgatatagctgtcggcagtttcgtcttctttcgtgaaaaccacttgcaagtcccacttggcataacttttaccgattcccggaacatacatggcatcgaaaaccacaatcattttcgcattttcatgactgcggtattcagccagaatatccagtaagcgatcacgggcgacatcgaaatgatcttctgctttcaacttggcgagttcaggccagttaccgatgacgttatagccatccacaatcataatatgttcgcgcatttacttaccctcatggcgactggcaaaagcttgatacatcaagatgcccgccgcaacactcgcgttaaggctctgcacgtgaccggccatgggaatggcaatggtggcatccatcaatttggcaattcccggcgaaatgcctttgccttcattgccgatgactaacgccgtgctgccttttgcgtcccactggcgataatcctgcccatccatggcggtgccaaaaatccacatgccgcgatctttcaagattttgatggtttgcgctaggttcgtgacccgcgcaaccggcacatattcgatcgccccagtgctgactttggccacggcactggtcaaaccgactgcccgatgctttgggataataatgccatgcaccccgctcgcatcagccgttcgcaaaatcgagccgagattgtgcggatcttccaagttatccagcaataagaagaacggatcttcccctttatctgccgcgtgcttaaacagatcgtccaatgttgcgtaagcatatggcgtcatcgccaagagaaccccttgatgattgccgtggtcactcatgagatcaagtttttgctttggagccgtggcgactaagatcttcttcttttgcgccatgccgacaagatgctgaatcggttcgctttttagatcggtctggacaaacagcttgttaatggtggctgcggttccggccttgagcgcggcttcaactgcatggcggccgaagacgaattcatctggctcatgttcattatttggtgcttgcggctgttttgccatgacccgtcttcccttcttcaacgtattggatacaccatgcggctagctcggcaacgcgatcatcgcggccttcaagatgcaagtaaccaaacagtgcttcaaatcctgtcgagatgcgatacgtgaccacatccgtatgtttggcatgggtgtaacttttggcattgcgcccatgcttgaaaacttctgtctcttcggcacttaacaaatccgccgtctgcatcccggcaatcaacgccgcttgtgccttggcggaaacaaaatccttggctgcgcgttgcaaggctgccgggcgcaccagtccgcgtttgagtaagtgttcccgaatatagacttcataaactgcatcgcctagataggccagtgcaatcccgttcaattgttttggatcaaatgtcattttctacgccaccgtgtcccttgaggagtgtcttccaaaataatcccttgtgctgccagctgatcgcgaatctcatcgctcttggcaaaatctttcgccgcgcgcgccacatcccgagccttcaccaaggcgtcaatattcgcatccagattggtcgggtcggtgaaaacaaccccgaaaatctgcagccaagcatcatactgattcaggagatcattgacactttcctgtttgacggtatcttcattggcatattcattcaacaatttggcaagatcaaatagcacagtcaggccattttgcacgttcacatcatcgtccattgcagcaatgaaacggtcttttaaggttttaagctcagcagtgatctgtgcatcaacgccggcaacagcattggcacggcgatagaccaagttttcccgggcaattttcaaacgatttaagctattagcagcattctttaaattcgcctctgaataccgaatcggcatccgatattgcgtccctgccatgaagaaacgcaaaacctggggatcgaccgttttgagaatgtcgtggaccgtaataaaattacccagcgacttgctcattttctggtcatcttcgccaatggtcacaaacccgttgtgcatccagtaacgcacaaactgcttgccggttttggcttcactttgggcaatttcgttttcgtggtgcggaaattccagatcctgaccgccgccgtgaatatcaaacgtatccccaagcagttgggtactcataaccgagcattcgatgtgccaacctggccgccctttaccccatggtgagtcccaactgatttcaccgggtttagcagctttccacaaggcaaaatcgattggatcttctttcttgtccagctcttcctgtgtgatatgctgactggcaccttcttcgagttcatcaacattttgatgggataactcgccgtaatgtttgaatttacgggcgcgataataaacatccccatcaaccgcatatgcatagccttttgcaattaaatcctggacgaaatcgacaatgtccggaatcatctgactggcacgcggatgcgccgtcgccggttcgatgccaagcgcagtggtatcctccatgaacgcatcaataaaacgttgcgccagatcaaggggagcttccccggttttgtgtgcagcggtgataattttatcatcgacatcagtgaaattcgaaacataggtgaccttaaatccgcgatattcaaaataacggcggattgtatcaaacgcaatggcactgcgcgcgttaccgatgtggatgtaattatagacagtcgggccgcagacatacattcggatttctccgggatgcaagggtttaaacggctctttttgtcgcgacatcgtattatatagcgttaacatcggctcatttccttcctgtagcgtcttacctgcattttacaggaaacagcagcgtttataaaggaacgtgacgcggttggcggtaataattcttccgcctttcaaaaaggaaaccttcaaattatctgtaaatgccaagattctcaccgatgagaaaattcttcctcccattttttaccaaaggcggggcttatgatagtcagaacatgtataagttgctccaattcgtcctgatcgctgttacaattcttaagcttaacctggcatcgccttcgcaaaagctcagcttgtatccgaatgtaaaagtgatcatccggtagtccgtgcatttgtagttgcgttaatgttatcaaggctctttcatagtcgctttgatagtaaaacattgcagccgtattatatagtgcctgaaaaaaaagatcctgctgaccatttttttgctttaaagcgaaatgaatggtcagcagcttttcaaatagcttttcaaagtatttagactctagaaaaggaatgcagtctatgtacaaaatatattccaatgaataccaagaagttcgtttcatcaagtaattcataacagtttctgagtcttgtttagaaaaacattctgcgccatcttcaatatcgagcttgaccgcagtaaccataatagaacgtaacttaaaaagtatgttatgcgtctttgagaattcttgaatcagttcttgcttcagttgatatagttggccaatatttttttgcaaagataactgcaataacttctggttaaaatcctgttgcgataaatcaacatcagaagttttaaactgattctttttctcaaagagttcaaagaattccgctggctcaacacacacattgtgcaaaagcgtaaaaagattctccgcagaaatctctgttcgaccgttttcaaacttagaaaccgtacttatgtttaggggcctagctatatcggaaatacggagtccccgatcagtacgaatttctttaaagagttggcctaaactatatcgctccaattttctcacttcctgttgatgagatgaattttaattttattataatcaaatgttctttgttgtacatgaaaaattttaatttaagcaattagtctgagtccatttccagatcctgttaatatcaacaaataaggaaggaaaatatgtttcaaagtactcccgcaattgttagttgacaatatgttaagcttcaatcagcttcaagttggtctatcagtaacggctatagcgtttcaaatgcgatagaatggctgaatgcccacgtatcaaaatgagtgaagggtgatgtaccactaatgattaatgcctactttttacaaaaacttctgtggggtgttaatgttgtatcactgattgtaatgttatgttttttattgccgggatatactgatcagtactggctaatttttatatgcctacaactcgttgttaacatccttgatcgaggacttttacgtcagcatctaccagaaaaatattccgactcaaatattggtggaagcatcaggtaccttattctggcggttggactaccacttttctacccggtagtttcccacaatcgttacttgtggttaatggtagtcattggaagtataaacgttatattcactctggcttctgatgcatcaaaacgaaccaaatataagaagtcttgaaaaaatatattgcagtcaccaagaactttctcgaaacataaaagcaacgcaaactcatgagtagcatgggtttgcgttgcttttgcactttcattttttagtgctgtaaaagtgaaccttaacagctaaaagtttccttaaccagctgatgcgccgaggttgcttggcagttttcgactaaatcggacttaaaatgatgcgatcttggcattaatctccccaccacgatgatgtggtaatagaaaaagctatcaaaactgactcataaaccatcaagccctaaatcttcaaaaaagttcatcaagacctgtcttaagccctttgcttttaatcaatcttccgctttagattcaaaatgtttaacgggtcgaacaagtctttgattcgatgttgtaactcatcaacagcaaagccgagttcttcgttgttccattgattcttgctcatccccacagcatgttcgccggaaattgttccgcctagtgcaagagctttgcgaaacatcatgcgaattgcctgcagcgcttcttttggcggttcaacttgatcggctggccaaatgacggttgggtgaacattgccatcgcctgcgtgtccggcggtgtaaatttcaacgtttaactctttggcaactgccgcaatataatccatcatttccggaagcttggaaagtggcacagccatgtcttccatgatgtgttgaccgtttgcaaacacagcaggcaacatgtcctggcgcagtttgataatcgcggctgattcagcgggatcactggtcacctgaatgtttttagcatggtcagcggttaatattttctcggcaattttcaagctcgcctcgccaccggtatccaagcggaaaatgagcatggcttcggcgccttctgcataatgcgtgccttcataacgatccagtgccgccactgttaaaccatccagtgcctccagtgtcaccggataaataccggacaaaatcctcaaccccttttgctaaagcggtcatattgtcaaaatacgccacgccgacaaccggagtgccaaccggaatcggatttaacttgacggtaatttccgtgatgatccccagcgttccttcagatccgacaaagagatgggttaaatcataactgaaggcatgtttataagtacgcccgccaagcttgatttcacgcccatctgcaagcaccacttttagtcctagcacgttgtcagtggtagcgccatatttcaccgtgctcatgccacctgcattcgttgcaacattcccgccaatgcttgaaatcggcttggaacccgggtcaggcgcataaaataggccttgttttcgggcggcttgatccagatcgccattgatcacgccaggttccacaacggccaataagtcgcctttactgatctctttgatccgcttcattcgcgctgtggacaaaatgatgctcccgtccagtccgtcagcaccaatcaccgtgctggtatcagctccttgaggcacgaccggaatgtgatattgccgcgccacctttaaaacgccttgaatatcaggcacgtcccccactgcaatgtaggccaaaatatgcccagctatctcctgttgggcattgccattagcgctatgttcgcgggcaactttatcatctgtgtgaatctccgcatgcggcgcggcatcctgcaatgcggttaaaatctctgcatgatcgtaagctgtaaaaattgccatgatccagaccccctgtcctgaccgtctatcgtcaaattttgctgatatgaatcgttcacttttattatggcccaattcacaaaagatggtcatgatttagtcttagcggtcgatctgggtttgattaggccaagcgattggtatcatcaagatcgcgatacgacagtttaggatggacggtaatcaccgcttctcccaaccacgttaaatctcgggccattcttttcgtctgcaatggccgccgcggatagccaagaccggtcactttcgtttgcgaggccacacaaatggtcaagacatccgtgtcggcgcaggaatctggctcatgccgaaaccgcaatgcattgaaaacttccccgggcgctatttgcaagggtgccgccatttgcggataagcaacgcgcaccacatgccgaccgtgagtatcaaaaccggtcaaaaccgcgacttcaggctgccccagcaagccaaaatgacgatcaaatccgtcaaaccggctaaagcgcggcagaatataataaaaagtcggcatcattaatttcagcatctgttgaccggttagcattagcccagcctttccagcaaaacaaccggccgcggcagaaccgggaatatagcgcaacgcaaaggcaggatattttgaggaagtggtaaccgaatttttcggggatgggggctggcgggaagacaacatcaacattcactcctatcgcatcattagactataaataaaataatactcggttaactgctgaaaacgcacgcgataacccttcgccatgccatcaaccctaaccttataaaaaacaggccgggcttcagctgccgaatccgacgctgtcccccctgcctgtcatctgaaacctaccccaaaaaccaacatcacctagcttgttcgaaacgcacccgatcaagtccgcctcgttcgcacagctagatcatgccgcaatatccatcacctttccgttcatcacgaaaagagccacccacttaacagacgaaaaagccctgccgtaaccaaccctgtcacaatgcccgccaaaaaatagccgactttggacatacttcgtttacgtttcattttcgcttcacctcagatgatgttaccgcttacccttaccaacaactttcattttaccctatcgagatgcatttgtgggttttcacaaataaacgtcggaaaatcaccgattaacgttgtgctgagtcgtcaagagttggatttagcgtccaagtaacgggtgaaaaaatgttttttctataacgcgccggctcgcgctcacacacaaaaacccgcggcaaacgtatgcgcgcgggtttttaaatttgcttaaagttgcgacgtaacaatctcaacattcttcaagacttgatcgcgtcccattaattcgatagtttccgctagttgtggaccatgcatccgtaatgttgcggcaattcggattggcatgtaaagcttgcgtcccttaacttgcgtctcctgcttgacctcgttaacgatgtgcccaatggaataagcatcaaacgtatcgagtgctcgaatctttttggcaaaagcttcgatcactggcttcgcgttatcatccgccagttccttgcgctcatcatcagtcaaatcagtggccttatcaaagaaaatatccgccaatttactaatctgagccgtataactcatttgatcagtgtaaaggctgatcagctgccgggcccattcaatcgtcttgggatccggatcgctttgaatcttgccatcttcaattaggttagccaatgacaggctcattaactcatttggattggtcttttgcttagccttgatgtactggttattgacccattccagtttcttttgatcaaaccgtgccggactcttggacaaacgcttaggatcaaactgcttgatgaattccttcttggtaaagatttcgtcttcgccaaccggagaccatcctaacagggtgataaagttgaacattgcgtctggcaggtagcccaattcacgatattgttcgatgaattgcaaaaccgtttcatcgcgtttggacaacttcttaccggttgcgccattgataatcaaagtcatgtggccgaagatcggtggttcccagccgaacgcgtcataaatcgctaactgctttggcgtgttggcaatgtggtcatccccacgtagcacatgactaatttccatcaaatggtcatcgacaaccaccgcaaagttatacgtcggcatgccatcacgtttttgaatgacaaaatcgccgccaagcgtgttggcatcaattgaaattttgcccttaacaatgtcattccactcataagttttatcagtcggaatgtggaaccgaatgactggctgtaatcccttggccttggctgcagcaattgcatccgctttttctgcttcactcatgccttcatattcgtactcgtaatgtggcatttcgtgacgggccttttgggcttcgcgatcggctttcagttcctcttcggtccgatatgattcgtaagcaaaacccttatccacaagctgcttgatcaacttgtcataaatgtctttacgttcagactgacggtatgggccaaagtcgccacctttatcagggccttcatcccaatcaataccaagccagtgaaggttgtccatctgactcttttcaccgtctgcaacgttgcgtttcgtatcggtgtcttcaatccgcagcaccaacgtccctttgttgtgccgtgcgaataaataattgaacagcgccgtccgtgcattgccaatatgcaaatgcccagtcggacttggtgcataacgcacccgaattggtcgatctgccaatgtcttagcctccattttctgtaaacatgcactgctagtgtaccacagaagggcaaacgatggatgggtccgagtgcaattgacacttacttaatttgctaattcgttgaccgccaacgcgaaaatctttagactgttatcaggctcagaaaaaggagtaattacccttgttctttgtttagcggattggatggcacacacccctcaacattctttgaacgcggaggtgatagccatgccaaaatcaggagacgaaaggggttcgccgcattggacgtggcgtcgattatcgtcgcgcttgccatactggttaccagaatggccaaagcttacgcgataatcaaaaaagctaaccgtaaaggctagcttttacccacagtcatctgaaccgcgtcgaggtcatcgggatgccgcctgatggcctcttttcaacgccattattataccttggatgtcgacaaatcgtcaagaacgaccagaccgttccttattagacgtcagcttatcaaattgaagccaattaaaacgctcactaacccaccgcttgactttagtcactaacttgtcggttgcgcatcgtccgttgccatagccagtaaacaagtaccacaattagcacggattgcccaactaaaatgaattcttcaaccgtcaaactgagtgctcctacttgcgccagtgccgcaggaaagtcgatgaaagcatgtaacccgatcggtaccaataaccagaaccattgcttccgtttaacgataagcaaccaaaccacaacggaaagggcaatctgtacggctaatgccatgatccgttccagcaacgacagcgaaactgtccacgcactcatacccgttagctgcttcactaccgcggtgattgccgacctcgagctagcaggtgtttgattgatcaccttttcaatctccccgctatttattatgaacgcaaacgcataattactaagtactgtcacgctgccaatcaaaatcatctccaagccgccatgtcccaagccatacaggaatggcgtctcaggatcgttaattttagcgggaatacgcttttggataaacttgaagcccaaaaaccggccaacttcttcaaagacaccggccaaaagcgcgccataaagtgcataagcccaaggtgtgtgctgaaactgccgggcaattccgcgaaacgggccttctagtacaccggcaaataagaagaagattcccatcccgatgaagaagattttagtcgcccctttttggggatgacttcgccgcttaataacccaaactgccagcccaatcggcaacgctaagcagatgagcatttgaatcaacatcatggtcacggctgattggctgaccatttgattattcacaactttttccattcgcttttacctctcaatcaaaccagaatgctaagagcacaataccaaggatcaataccagcgttagtcccattaaaacccaactgatcggccgagccatattcaacgtaaacccaatgccgatgcgcttctcgacaaaaatggctgggtcgccgggattgtagtaaaaaataccaccaatccaatgctgattgtcgttcagcaccttgccttttgcatccagtttacgcgtgccagcaatataagccatgggcagtaacataaccgagaccagcgtcagggttgcggtgagaatcacgttaagccactgccaatcgctagacattgccggtaacatcagctgtaagaccagcaagctttgtgagaggaagccaattaaaagcagatagtacaaaatagcgttacgcacgcgcccggatcgcggttcggcatccggattaccacgaaccgtaccacgtgctcgacgggtcaaataaaaagcggttaataagatcagcgtttcgatgcccaacgccattaagagcacgatggtatctgcggaaggctggcggaaacccagaaaaatagccagcaagcattgtggcaacagaaccagacccgctgcggccgggaccagtgtttgcggctttaggtttgccaagtcaattgtcacttgatggttagtcaacgcctgatctgcatgtagttgctgcatcaattgtttacttttccggtgaccatcgatgattaatacaccattaaggctcactgttgctaaagtagcggcaatttgaatccaggcaagggtcactgacgacaatgcccaaatagccacggccccgcctgccaaaacagcaatcaccactgcgcctaacaacgaagcaactagataacgccgtcgcaacgtcactgcttcaggacgttgccaaattgatgtgcgtgcataaacaacgccaaagagaacattgcggcgcgacagccacggcagcatcgcctgaatggcaacaagcacaagccaggttatgacaaggatcaaaatttctgctttcatctaccttcactccccgttagttggtcgtacagctgatcaatcattttatgcaccgtgcttcggtcaaggttccgcgccaccgcttcggcaacgactttttcaagtgctggccgtaaaacgttctcgacagcttgttcaggggcgccgcgtgattggaccaccgcaccgcgtcctcgttgtatgactacgaaaccttcttgttgcaacgcttgataggctttgttcactgtgtgcaagttgacacccagctcatttcccagtgcgcgaatagaaggcaacacggttccatttgcgagcgtgccagtcgcgataccattcacaatagcatcgcgaatttgttgataaagcggtactttagaagccaaatcaatcgtcaaacgcacaaacccgccttctttccgttacacttgttctacaccatgtataacacttgtgtgaaaaaaggtcaacgaattttggctaaattaccgccgctcgactttttttattataagtaccttaaaagacgccttttttaccgcattgaaatcggcgtaccaatttgtgcgagttgatcatcatgcgtaatcgcaatcaccaaccgcgtttttgccagctcctgcagcaagtgaatcacatccgctttgatttccggataaatattggcggtaggttcatctaaaacataggtcgtggcatgttccttgctcaaggcctttagaagtcgaaccagttgcaactcgccgcttgaaagaatatcgacttttttatctagtaaattgaatatgttgaaattaggcgaatggaacacttgagcaaaatgcttcggttcttcatttaaaaatgccgccacattgcgacagtcatcggctaagtattcgccaactgtcagatgcgggctaggtacatcttgaaataaaaacccaatttgctcgcgccgcacttttgccaaatcgacttgtgccgcattaagcccatttatcagcacatcgcccgtcatttcaggttggtaaattccggtaatggttcgaacaaaagtcgtttttccaatcccattgtcgccggaaataacataaagtccgggcgttcgaaatgaaacattcatgttcttggcataaaacatctcatcgttacttggctgctgggaaaaccttctgacattgaatcctttgacctcaatagtgtgaatctcgttcacttgtccggtccctttttcatcaggcgcaatgcttagaatttgtcgcatgcgtgcaagcgaagcccggtatgcttccgtgcccattgctaccgtcagcagctggtcaaccgaatttaacaattgactgaaatattgcaaaataatcgagaaaaagccaatggtaatctgtccattgagcactgcaaatccgccgactaagaagaaacaggtttgaaagatcaactgaatactgatttgcgaagcagacatcgtaaaccgaatccagaaatctctgatataagtctggaatagccctgcttcaacccgattcaagcgctttgcttcgttctgaaaactgccagcacctttaatttcaatataacggccgataaaatcattgcgcgccgtgaagtattcgttttgcttgttcttaactcgcaagctgatcgcgtagattttctggtggaagacaacgtaaatcacaaaataaatcgggacaaagattgccatcatgccaaaaattttagcatctgctttcatcacataaagggcaatagtcaatgttgacacgataatgccgatgagccgcaccacggtatccgcaaagaagccgacaatttcgttgacgtcatcgtttatgcgggaactcaaggtagtcggactccaggtcaggattgcgagggtcttcttagtaaacaagcacgccaaaatactgcgattcatcgccaggattgttcgccgtcgcgtcaggatctgaatacgattctgaaaataggaaacgatcagccgcgacagcccgattcctagaatgattagcagcaaggtgacaaataaggtacgatcgtgactgtacacaaggctatctaacagtttaccttctaaataagtcccgccagtgattaaactggtcccggtcactgccagtaaaattaatgcgatgaagggagccgtccgttttttcagaacatgtttaatgatgggtggcataggcgtacctctgtttcgcgtttgacgtgtttcgactggttctgcaaaaagtccggattctgtccggaaaaaacatagcattgttacatcgtcctgccattctcgctgcatagacaactatttaccgaaacagaactagcttgtcaggataatttgtttgtacctgtcttcatgtgattcgtcaacgatttgcttaacactaatgccattatcaaatatttctttaattttgcaacttaatcttttgcttagtaactgaggcagcaatttttgtgatcgtgttctttttacgtttgccaatcaattatgaatcctaaccagttgtttctttttgcttgttaaccaggctaatattctcatagccgaattttagaatatgtaaagtcgttttctcatttcaattgtcagccttttcgccaccaaaaaaatcggtcccaaataccgagaaccgattttgcttaatcttcatgtagctgatttagatttactttcatccactactggcgcttcgccttacgaaacagcagtgtcgaaccaaggcccataagtgataacaacgctaaccccactgctgcaataccgtactcgtgcttttcgttggtattaggcagccgccgctgagcacttggcgttatgacttcagttgtggcagactggctgctggttgatggtaccgttgatgtttccggcgttgttggcgtaactggaatagccggtttcgtatagacaaagctgacaaccaatccggtatctttaggaaaagttcctgatgctgcagcactatcagctgccaggcgcacataccggtaaccgttaatcgtgatcggaccggtcgtataagccgatccactctgacctgccaacactctgttaggggctaattcgttaccattttcgtcaacataacgaaccgtgaccgatccttgtgtggctggcacttgcttgtaaacaaaggtaacgatcacattgccgttgataaaggtattaccagccggcgcactgccttgggccacacgggaaaaggcatagtcgctaatctcaatgggccgggcttcatataaatcaccaacttgacccgtcagcgtcttatcaggggcaatgcgcttgccagcctcatccacaaatctttccgtcacgcttccttgcgctgccggtttctctgtataaacaaaagtcaccgtctgcggattagcagtaaagctgcctttttcaggcgcactgtttgcagccagatgcgcatattcataatttttgacatttgctggcacggcagtatacgaaccaccgactgtccctgtcagggttgtggcaggcgcgatttcattgccatgttcatcaacatacttcacattcaccgttctttgagttacaggaactttggtataaaccaaggtaactgtcaaagtacccttgctaaaggtcccgttaattggcgcactgccattagccaactttgcatattgataattggcaatcgtcgctggtttaattgtgtacggtttcccaacttcaccttgaagaacagtgtctttaacaagcgtgttcccagcatcatcaacacacttcaccacaacttcattgctgctcgtcggcgaatcagcgtttattgtttgctgattatttaaattcaattcttgcccaagcgttgccggttgcacggccaatgtggctgtcctagtcgccaccgagctcgccttaacgtgactaggttgatgaccgatagccaacgcaaagacaccaattaaagctaccagccatagctttcctgatttatataacctataacgagtcttctcttctccaaataaacgcaatggtcttgcccctctttcgtgatccagtcgaaaacttttcaactgaaaacaacaaaaataactgctcatacattcacttgtattgtagcattaattagtttttaaagagttatcagctacaccttagcatgccaataaagccgctacgtcagcgtttcataaactttatcaataaaatatcggagttccaattttctttttgaatccacactgatatggtattcagcgtttattcatgcttctagacggttgacactgctttttgataccgttgttctgataattaatttgaatttcgttttttaaattggatcaatcacaggcttctgataccaaccccgtaattctgtctcagagaagattcgcacaagttttgcgacagttggggttggaacaagatgttgatggtttgaagcagtttcgttcacaattcaccaaacagttcaaaagtacccacaaaaagctctataagcttagggaaattatcgtttcgtgcatcatcatggataccgaagatagacacagtttgctttcgccagaggactccaaattcgtcagtgactatctttttgaaagaaacatctggtatacccttgaatatgttttatatagcgattgtgtgcctttcttacagccagcggactttgaaaaactatacaataagttcttaacgattcacttttcatttcggcaacgcggtgactacatggatttgttctttcaatctttctacaataccgctgttgcactctactatcgccaagcatactcgccggcaattcaaacattggataggctaaaagaacagcagattcccgacagtttattttcgattcgactgcatttgcgcttgttacgccgcttgtgccaatacaagctcaccaacagtaccgaaacggccgctgaattatcagagctcgtaaaagtaattttcaaaatcagtcccgcattcgggcgtcgctggaaagcagaatttcaatttcacgaacctgtaagtgaccatacttaatcaatataagccaacaaaaaaggacagttccggtattcccgcgctttctagagaaataccgaaactgcccttttattttttcttaatccaattacctttccttgtcgcgaatagccttttgctgatgagccggcttggcaaagatcatgcgccctgccgctgtttgtaaagcactggtgacaattacttccagcggtttgttcatgtagaatttaccgtcttccaccacgaccatggtgccgtcgtctagataggctacaccttgctgtcgttcggagccggatttaatcacggtcacggtcatgttttcgccggggatgacgtctggtttgagtgcgtttgccaaggcgttgatgttgagcaccgggacattttgaaattgggcgactttgttgagattaaagtcattggtcatgacaatcccatccagtagttttgccagtttaagcagcttgctgtcgacttcggtcatatcgtcaaaatcgccttcgtacatctcaatatgaatgtccttgtctttttgcatggcatttagaatgtctaagccgcggcggccgcgcattcttttcattgagtcagccgagtccgagatcagttgcagttcatgcaagacaaaattcggcactaacatggttccttcgatgaagccggttttggcaatggcttgaacccggccatcgataatcacactggtgtctagcaatttgtatttgcgaaaatgatcgccaactttgcgctcgagcacctgatcattttccgtttccgtattccgccggttgcgaaagctcagaagccgacgccattcttcgctgcgtgtcgtacccacccgaaaacccaagtaaccgaataatagcatgatgatgagtggtaggaagatattcagcggcgcgatgaagccataaaacggaatggaaataatggcggccagaatcaacccgataatcgtcgacaaactgccaaacagcagatagcttggcgatttggtgtttaacgttttttccagtaccttcaagcgcttaagaatccagttcacactgagactcgccaagagcaagaagataatggcaccgattaagccgtcaatgagcaagttatttaagaagtgattggcactccaaccaataagatcccaaagtgacggtaatgcgcccatgccgacgccgatcccaatgagaccaaagatcaaataaataattcgtttcttcatgatatacctcctttctaagtttaattaaaaaccttatgcagcgcttcggcaatgcttgtgacgccaataacctgaatatctttaggcgcacgccagccttgcaggttattgcgcggcacaaaaattcgtttaaaccctaacttagccgcctctttcacccggtcttcaatgcgattcacccgccgcacttcaccggttaagccaatttcaccgacaaaacaatcagtcggcgggatttccttgtcgcggtatgacgaggcaattgccactgccattgccaagtcaatcgccggttcatccagcttgacgccccctgttgctttcaagtaagcgtcctgattttgcaacatcaaattggcacgtttttccagcacggccataatcaggctgacgcggttgtgatccaagccgctgctcgtacgtttggcattgccatacatggtcgggctgataagtgcctgaatttcaaccagaatcgggcgagtgccttccatcgaaaccaccaccgccgatccggttgcaccagccagccgttcttccaggaagatttccgagggattggcgacttcctgtaaaccattttgatgcatttcaaaaattccaatttcgttagtagagccgaaccgattcttgaccgaccttaagatgcgataggtatgatgcatatcgccttcaaaataaagcacggtgtccaccatatgctcaagaatcttgggcccggcaatagcgccttccttcgtcacgtgaccaacgataaaaatcgtcacaccttttgacttggcaattcgcatcaattcggcggtgacttcccgaatctgagcaaccgagccgactgccgaattcatgtccggtacattcatggtttgaaccgagtcaatcaccacataatccggttgcatctggtcaatcacgttttcgatacttggcatgtcggtttcgggatacaaatacatgccggagttggcaacccctagccgccctgcccgcattttaatctggctggcgctttcttcacctgaaacgtacaacaccgtaccacctgtgctagctagctggccagacacctgcagcagcaaggttgatttgccaatcccgggatcgccgccaatcagaaccaacgagcccggaaccacaccgccaccaagcacgcgattcaactcggccaagcctgttttaacccgggtttctttggtcaccgtgacctcatccatgcgtgtgggcttaaccttgctgccggtgcgcgtttgccgcggcgccgatttagttgaactgatagtttcttcaacgagcgtattccagccgccgcagtttggacaacggcctaaataagtcgccgaaatataaccgcaattttgacatacatattgtgtttttgctttcgccatattatcccttcaatatctgctagtggtcggttgagccaaaaccgctttgtcgttgcgccaagccgccttggtcaccgtctgccaatagaaatggcataaaaatcccctgaccgatgcgatcaccttttttgatcatcacatcccgcgggaagaaattcaggagctgaatatagatttcgccttcatttgccggattgttatagtagtcggcatcaataaccccaataccgttgggcagcgtcaggccatgcttaagcggactgctggaacgattggccaaaatcaacacttcattaggctgcatataggctttaatgccagtgggaaccaagtaaggctttaaaatcttcttcgcccgttcaaagtccttattcgtcaacggatgctcatttttaatcaaccgaaaaagccgaatgaagtcataacgccaaatactccgcaacagaaaatcttcgcgcgcataaaaatcatacccagccgcctgcttagtctggcgggtcggcaaggttaagttgtcatcttgatactttgaaacaatttcaaatccgcgggtcttcatgaaaatagcctccaaaaaaagtgtgagcgtgaaccagcccggttagaaaccggagtgtaagtggccttgggcgtgatggccgggtttgggccattgcgaccaaggtccttacacgcaggtttctgggctggtgaacgcgttatggtgagcgcgacccggcgcgcttagaagtcggagtgtaagtggccttgggcgtgatggccgctctttggccattgcgaccaaggtccttacacgcaggtttctgggctggtgaacgcgttatggtgagcgcgagccggcgcgtttagaagtcggagtgtaagtggccacagacgtgatggccgggctttggccattgcggctgtggtccttacacgcagacttctgcgccggtgaacgcgttatgacaagcgcaaaccagcttgtgcaccagaaagcacgccaacatgtccaaagtatcataccacgcggagacaatcgaaggccacggtgtaagggcttcccttcttgtaattataccgttttcctgataaatttggcttataaaagtcattcatgaattgggttaacgacggatgggtcatcagacgaactgtgccagttacgcgccttgattcttaataggatgaccatcattcaatttgccaaggaggctgctatggaatttcaacgtgaaccaggacgaatttttaatacggattgggacggccgactgatggctgaagtcactttccaatcaatcgatgacggcaaagcgtgggcagtggatcacacctttgtcgatgaaagccttcgcggtcaaggcattgccgctcagctcattgaagccgtggtcgcagcagcgcgcaaagaaggcaaaaccatcgagccgctatgttcctatgccgtgcatgcattccataatcatccggaatatgcagacgttttgcgaccagttaaagatcagtgaaaaaatccttctcgaagctgccgaaccttggcagcttttttggtatgagcgtgagccagcccggttagaagtcggagtgtaagtggcctgaggtgtgatggtcgggcttcgaccattgcgcctcaggtccttacacgcagacttctgggctggcgagcgcgttatggttttatcgtctcggctccccttttcaacaaaacactaacttttacccaaaagcttctcagtttcatctttaaatctaaattaaattggggtaaggtttctttaatgcaatttaaaaaggaggatgttatgtcagaaattacatttgatcaaattaaagcctttcaagatcagcttgatcagcatccggcatcgggtgcacttggccgagctgtccaaaatgtcgggccacaagccgcaagccgtgaaaccatggacggcgaagatatgaagccggttttttcaattgacctagacaccggcagcgttgccaaccagaaaaaaagcggccggtgctggctctttgcgacattgaatacagtccgccacgggattgcggatgaatttggcatcaaggatttcgaattctcacaaaactacaatgccttctttgatcgcttggaaaaagccaatttattttatgaaaatattctggcaaccgcggacaaacccctggatgaccgagaagtcgccacttacttaagcggtccagatgaagatggtggccactacgatcaatcggccgccttaattgaaaagtacggtttggtgcctaagtcggtcatgccggaaacttataacagcgacaaaaccgctgaactcaacagtgtgttgaacgagaaattgcgtaaggatgctaaggtgttgcggaccctcaagcaagataacgccagcgaagaagccatcgccaagcaaaagcgcgaatttctcagtgttgtttatcgcattttggcttacacctttggcaatccgccgacaacgtttgatttcgagtaccgtgatgacaagaagcaataccatcgcgataccaacttgaccccgcagtcattcttcaaaaagtacgtcaaatggcattttgacgattacgtggtgattgccggtgatcccgaaccaaccaaaaagtatcagcaattgtataccatcaattcagccaacacagttgttgaaggccatccgctgacaattttaaatctccctccggaacgtttgaagcagctggcattagcgcaactgcaagcaggtgaagctgtctggtttggcaatgatgtactagccgacatggatcgcaaatccggcacgcttaaaggcggattgttcaattacagtgatttgtttggtgtcgatttccatgtgaacaaaaccgaccgtatcgtgaccaccgaagcggaaatgtcccacgccatgaccctaaccggcgccgatgtcgttgatggcacggtcaccaaatggaaagtcgaaaattcatggggcaaggaaaatggccatgatggttactttgtggccgatgccaactggtttgaccagtacgtttatgaagtcgtggttcgcaaggatcttttaactgacgcggaacaagcgcttcttcaaaccgagccgatcaacttgcctgtatgggattttctaaattaagattaactgatatgctaaactaagcgagtcacaaaacggtgccggcttatgacgaaatcttcgccgccttttcgaacgaccatgattttcattaccagccgcatggtgactcagcttatgcacataaaaaggagtgtttatttaatgtctgcagaaattacttcaggcgatttggatcagttcaaacaggatcttcaagccacacctggcgccaacgccttacaaaaagcggtcatgaacaatggtattaatgcaactgccgagaataccgatagcaaagttgccatgacaccaacgttctcaattgaacttgataccggtgctgtgtcaaaccaaaagcaaagcggtcgttgctggatgttcgccgccttgaatactatgcgtcatggcattcaggcacagtttaagatcaaggattttgaactgtcccaaaactacaccttcttctgggacaagtttgaaaagtccaactatttttatgaaaatgtcttaaaaaccgccgatcaaccactcgacagccgtaaagttgcctttcttttggctaccccgcaacaagatggcggccaatgggatatgctgtcagccttaatcgaaaagtatggcatcgtgccaaagtcagtgatgcctgaaacctacagttctagcaagagtaacgaattaaatggtttgctcaacttgaaactgcgtaaagatgcggtcaccctacgcaagttagttgctgacaaagctagtgatgccgacattgaagcagccaagcaaaaaatgctggctgaagactatcgcatcttggcatacacgttaggcaacccgccaaccaaatttgactttgagtaccgcgatgatgataagaattatcacattgatcgcgaactgacgccgcaaaccttctttaagaagtacgttggctggaatcttgatgattatcaaagtatcatcaacgccccaaccgctgacaagccgtacaagcacctttacaccgttgaaatgctgggcaatgtcgtaggtggtcgtgaagttcgccacttgaatcttgacattgataccttcaaagacttggcaatcaagcaactcaaggccggcgaatcagtttggttcggttccgatgttggtcaaagctccgatcgtcaacttggcattttggacaccaacatttacaagaaagatgacctgttcaacaccgacttcaccatgaccaaagctgaacgccttgactatggcgaaagcttgatgactcacgcaatggtcttgaccggcgttgaccttgtagacggcaagccaaccaagtggaaggttgaaaactcttggggcgaaaaagtcggcgaaaaaggttactttgtcgccagcgatgcgtggtttgaccaattcgtctaccaagttgttatttccaagaagtatctcccagctgaactacaggatgtcatcaagaacgaatacgacaagccaaccgttcttgcaccttgggatccaatgggtgctttggcatcaagataagcttgatctgaaaacactaggataactggaaaagtctcgtaattttgatctaaagttacgaggctttttgtataccgccgtaagcgattcgaaccaatgcggctgactgcgtgacttaacgctcataacgcgttttccagcgcagaagtctttgagtctgataaaattgtggtattctggttgcaactggattaaatcaaatgaggggatcgggccatggggacacaattagcttttgattggcgccaaatcattcattcacgcaaaaacattgccttattggggttgttctttgcggcattcatcatcgcattcttcgcattagtctggacgcaccgccttgatattcaacagacttccgaggccactgccaatgccgccgtggctaactatgcggaatataacttggacacactgagcaaaacccaaaagccgctattggcgaatctagatgaccaaaattcggcgactggtgttatcgacttgggcatccagcttgatcaacccgatacgacccgtaacgggctgcttagtttacgcactgctcaacttgaaatgcggcaacggcattataaagcgcttaataccatgccgctgccgccgctgcaccaacttaaaggtgacgttctggcgcttaccacgttaaaaaagcagcaaaaacctgccgtcacgacggtttccactagcgcggcgtatctcgtcaccatcctgccttatctcagctggttaaccggcgcggctgccgtgctgctagcctgtgatagctgggttgaacgacgccgccaccaaacgctgattagcgcgcgtcctttatctgtcggcgttgccggcagcagtcgcttgctcactttaattggtttttacatattgatccttgttgcaggtagcatggctgcaatcggcttacctgcgctattaaaaggcttgggtgacttcgactaccccatggccatcatgggacaaacattactgccattgtgggaatatttacttattttcgtgggtctgacattactggccggcatttggatcattagctttagtatgctgattaacacgtggataaccaatgcttacctcacgacctttattgtgaccgccactgctttattgccgcttatattgccgcaacttttccgctttgtgtggtttctgccattctcctatcttgacgttgccgcaatgatgcgtggaacattgattgatcgactgaatcagcccttagccagtatttggatcggtacaggcgctttattcatctggtcggtgcttaatctgggactctttggttatcgggtcagaaaggaggcagcatgatgcgatattttcgattccaactccatcaactgcttaccaatcgtaaaaacttagctgtcattggcatcgcactcgttgccttgatttgccagttcgtctttttcccgccaaatcaggtgccacctgaacttccgacaagtacggtgttgacgcgtgatcgcgataaaaatgtggcgtttgtcaatgagccgcatggaccgcataccgcgatgtgggtcccttccacccgtcaactcgtcaaaattgaaaatcgcatgttaacggcgcaaaaacagcagcattcgcaggcctatgtgcaggcaactttggattatctggcttttgtacgaaaaaatgccgccaatcctgaggctcaaagtagcccattccactatccgctaacatattattttgaaaatcggcaataccctgatgccgatgctgcttttgccaatatcaccctgacgcgcgcgctgatgactttagccgatcagcgcgatcccgacatgactgcggttcatcagcaaactttctggcagacgcttttccgtggcgcgttaggcgggtggctcactgcgctactgctgatcacgatcttatttgctaatgatttgctgacgagcgaacaacgccatcgcagcatcgttcggtcatcgcctctaagtccctggcatgccatcaacaccaaaaccttgaccgtgctaacagccttagccggtgtacttctgctatcagcgcttgttgttgccggcttcgtcatccctactcacggagtaggatcgctaacaactgcgatcgcctactttgccaaagatgggatgacagttaccgttgatccgatcgcgctcagcattgctctccccatcatcctcggcttgacaatcctattgatgtggctctttattcggttaaatctactgtgtcagttactttttcacaacgaactggttggactggtactcagtgcactcttgctattcggcgagccactctacttcatgcatgggttggctttttccgtcccgcaaaccgcatactacctgcccgggtacatgaatccggcggcgattgtcagcgggttgcaaaactttcgctatgataccagccgcatgagtccgctcgctgctttgattgtggtcggcagtgtgattatcgtgcttgaagtgatcctattcatcatcacacatcgacgccgggcagcaatcgttaaataaaggaggccccatgatggaattacaattacaaaatctcgttttgggtttcaaaaataaacccaatgtcattcatgatatcagcctaacgatgacgagcggctcaattgtcggcattgtggcgcccaatggtactggtaaaacaaccttgctgcgattgattcttaatgatctcaaaccacaatccggcaaagtggtattagatggacaaacatacggcagccaaaagcataccctcgccatgcatcggcaaatgtgccttttcccggttcaagatgatctttatcctgacttatcgggcaaggcgcacctggcatattacgcccgactttggcataaccaaacgaaaagtgttaagcaaattatcagcgcactcgacatgcaggattatgtcaatcagccggtgcgaacttattcaatgggcatgaagcagcgtctttgctttggcatggtgatggcggccaacaccccgattatgctattagatgaattcatgaacggtttggacacgatcaacgttgcgcgcatgtcgcagattctgcgcggattgcgggcagaaggcaaattgattattacagtgtcgcatctattgaataatctgcaaggatatgctgatttcatctacttcatgcgcgatggcaaaatcatcaaaacgattgatcagcatgaacaacaacctttgtatattcaagtggcagccgaagaagccaaccggttaccgcgcatgccttggcagcactatcccaatggcatgttggtattgccaattaacaacctccccggcgaacattttaaccagttgctgctaggactggctgcgcatcacattgcgtttaaattagcaccactggatcttgaaacttacttcaatgaattttatgatgccgattaatcaccaagaccactcaaagtcgcttgaacagcggctttttatgcaagtttttctggatgcaagatattgggcaaaataaattaagagccttcccttacaatgacactcggttctgctacaatgacgttattacttttcaggaggcacaaatatggcgtcaggcttgactgctaataaaaaactgcggcataagattaccgcggcggctttactcgtaacccttggtgttgtctatggcgatatcgggacatcaccactttacgttatgaagtcaattatcgctggaaatggcgggatgggacatttcgataccaattttctagtcgggtcggtgtcgctgatcttctggacgttgctgattatcacgaccctcaaatatgttctcattgcgttgcgagccgataacaacggtgaaggtggaatctttgcactttacaccttggttcggcagcgggcgcggtggcttgtactgccagcgatgattggcggtgcggcgttattagctgacgggatgttgacgccagccgtgacggtcacaaccgcgattgaaggtttaaaaggggtccatattaacggcaacattttgatcgacaatcaacaacaggttatttgggtcacgattttgatcattaccttcctgttcttcatccagcgttttgggaccgacctgattggcaaggcgtttgggccgatcatgtttgtgtggtttaccttcttaggcgttgccggctttattgctttatcaaaagactggtccatgttgcgtgctttgaacccttactatgcattgcgtttgctggtcagtccggataacaaaatgggtctgtttattctagggagtattttcctggcaacgactggggcggaagcgttgtattcggatatgggccatgtgggacgtggcaatatttacgtcagctggccatacgttaacctatgcttagtgttgaattattttggtcaggcagtctggcttgatcgccatgctaatgtgagtgcttataatcagattagcgatttcaacccattcttccaaatgttaccggaaagcattcgcctaggcgcaattattctagcaacattggctgcgattattgcctcgcaggcgttgatctctggttcttacacgctggtttctgaagcaattaaactgcgctttttgccgcggctgcacattgtctatccgacacggcttaaaggacagctctacatccccatggtgaacacgattttgtggctcgcctgcttgactattattgcttacttcaaaaccagtgccgaaatggaaggtgcttacggtctagccattaccatcacgatgttaatgacgaccttgttgctttatcaatatctgcgcgctcgccacgccccaaccttgatcgccttgggtaccttgatcttctttagcgcgatcgaaaccgtcttcttcatttccagcgccgttaagttcctccatggtggctatgttacggctatgatcgcgttcgtcattctggctattatgtatgtttggcaatatggcggccggattcgcgatgataacacctaccgcgctgaaatggcctcactgtttgcgtataaaaagcagctatccgaacttcgcagtgatccggaatatccaacctacaccaccaacttggtttatatgacgcagattgccgatgatcactacattaaaaaagaaatcctgtactccatcttggataaacgaccaaagcgcgcccgtgtctactggtttgtcaccgttaacgtcacggatgagccatacacggcgcaatatacaactgatacgtatggcactgattatatggtcaacgtccagctgtatctgggctttcggatggagcagcaggtcaatgttttcctccgccagattgtgaatgacatgatgcgcgaaggtgaattgccaacgcaaccgcaaaaatacaccaccattccggatcgacaggttggggattggacgtttgtcttgctgcatgaagaattgtcaccgcaaactcagatcaaaggttttcagaagacgattatccaggcgcggctatggcttcagcgcgtgacagttacacctgctcaatggttcggtttggaatatgctgacaccttggacgaaactgtcccgcttgtacttggtaagattccgatcaccaagttaacccgcctaagccgatcgcaagtcgacgcgcaagctgaggatgaagacgactagctattttagtcagatcacaacacattcgctagcttaagcgatggcgcacacatcatgcgctccccggtgccggctcacgcttacagaaaaaagtgtcccaaaagtcatgactactgacttttgaggacactttttaaatacaaattatagtggcaaatacaaagtcataccgcttcagtgctcaaaccagcctgtctgtctacaatctacgcgccggctttaacttttttcatggcgcgcaaagctgcttgggccgctgcgagtcgggcaactggcactcgataaggtgagcaggagacgtagctgacgccgatttgatcaaagaacgccactgaatccggatcgccgccaacttcgccacagactccgatcggcagttgcggctttgtttgacgaccgtttgtaattgccatggccatcaacgcgccaacgccttccgtatcaaccgtttggaaaggatcatccggaagaattttctgctccagatatgcgggtaagaaggatcccacatcgtcacgcgaatagccaaaagttaactgggtgagatcgttcgtcccaaaactgaaaaagtcggcggtgtgagcaattttgtccgcggtgacgcaagcgcgcggggtttcgatcatagtaccaacttcatagctcacctgcatcccttttgcggcggccagctgttcaatttgccgaacaaccaattgccgcacccaacgcaactcggtttccgaattggtcaaaggaatcatgatgtgcggtgttacctgcataccttcatcggctaaccggaaaaccgcatgcatcagcgcccgcacttgcatggcgtaaatatccggataggtcacggctaggcgatccccgcgatggcctagcatcggattgacttctttcaacgctgccatccgttcgcgtaactgattttgctccaaccccagctcatgcgcgacttgcccgatttcacgctggtcatgcggcaaaaattcatgcagcggtggatcaagcagacgaatcgtgacggttttaccagctgccaagcgatatagctcgtaaaagtcctgttcctgcattttctctagtgcggccaagggtaccttgcgtccggctgcatcttttgcgagaatcaaccgccgcatttgtaacaatcgttctggttggaaaaacatgtgctcggtgcgcgttaggccgatgccatcagcgccaaaagccaaggcctgctgcaaatccttaggtgtatcagcattcgtaaacacgcccatgcggctggcttcttttgcccatgctaacagtgtcgccagactatccttgaccaaggcggcagtggtcgggatttggccgcgatacaaattaccggttgtcccatcaacggatacccaatcgccttcatgcagcaccgtatcgccaacagtcgcggctttggcatgctcatcaacggttaaggcatgcatccccacgacaccggttgcccccatgccgcgcgcgaccacagctgcatgtgacgtcatcccgccgcgtgcggtcacaatggcctgactaacaatcatcccttctatgtcttccggtgaagtatcctggcgcatcaaaatcacttgatggcccgcttcatgagctgctttggcttctgctgccgtaaaataaacctccccagttgccgcccctggtgatgccggtaaaccggttgccaaaatcgtatgtgcctgtaacgcttcaggatcaaactccggatgcaacatgtcactcaatgattgcggttcaatacgcaacaacgcggtctggcgatcaatcaagccttcgttaaccaaatctatcgcaattttaacagcggccgccggtgtccgtttaccattacgcgcttgtaggagataaagttggccatgttcaattgtgaattcaagatcctgcatgtcgcgataatgctgctccaacgtggtcgcgatcgctgccagctgattataaacttcaggcatttgatcgtgtaaaaccgcgactggctgaggcgtccgcactcctgacaccacatcttcaccttgggcattcaaaagatattcaccaaacagcgcgcgttccccagtcgccggatcacgggtgaaggccacgccggttccggaatcagcgccagcattaccaaaaaccatcgtctgaacgttcaccgcggttcccaagtcttcgggaatgcgattttcgcgccgataaaccacagcacggcgattattccatgattcaaataccgctgtcactgccgccagcatttgcgctttgggcgattgtggaaatgacttgcctgcctcaatataaagctgcttaaatgccagaatgatttgctgcaggtcagcggttgtcaacgccaaatcagagtcataccctttttggcgtttcacggtggttaaaatgtcatcgaatcctttttccgataagccgtaaaccacattaccaaacatcgccagtaagcggcgataactgtcatacgcaaaccgaggatcggcagtttcccgggcgagtgcctgaacggtttgatcatttaagccgatgttcaaaatggtgtccatcatgcctggcattgaaatcggtgcaccggaacgaaccgacaccagtaatggcgcaaccggatcatcgaatcgtttcccggtcgctttttctaacgcctgtatgtgttgatccagctcggttaacaacgcttctgaaagcccgtgatgctgttgataatcgtggcacgcagctgttgtgagcgtaaaacccggaggcaccggcaggccaagattggtcatttcggccaaattggcacctttgccacctaataatgcccgcatctccatattaccttccgcaaacgcatagatttgtttcatgataaagccttcccttcactaaatatgacgttatatatattcgctatataatgtattatttagcaggcaaaaatgcaagcgtttacacttagaaattggtctaattcggaaaaagtttaatttcataacgccatctaatacgcaaaaatctgtttgcaagcgcggcgatgcgcggttaatataacatcccatttcacaacaagaaacttgcctataaggaatgtaaaaagtgtcctatttctcgccaaaatcgagaaataggacacctttaatttgaagctgcaaatgaaagcccaacctcatgctgcaagtgtttcaattaaatatttaaagatccggtttttggtgatcttgccaatcacatgagtgtccccatgtttttggatcacaggaagtgaatcgacattgtgtttcaacaacaacttgctggccgccataatggttgtatccgccgtcactgtcacaacattgggcatccgcgtcatgacaatactggccggtaaagtggtgtcacgatccgtaaagctggcacgcaataagtcctttcgcgagatgaggccgaccaaggcgccatcatcatctaacacgtataaggagccgacatccgccaagaacagcttggttaccgcttcttccatcgaggttgtcagcttaatttcagtcggcggcaataatattttggcaatcggggtattaaacagcgcatcgttgtctgctgataaaacactcgctccttggtaggcgtatcccacttttggccgggcatctaaaattccaaccgttgtcagcaagcgtaagtctgcgcgaatcgtggccaaactaatctttaattgtgtcgccagcatttccccagtcatcggactttttgcttttagtaactgaacaattttttgttgacgtttagtaagttgcgtaagcgctcctcctcatgattgctaatcaacagtataacattttcagggaaatatgacgtgatatttaatcgttaatcacaacttaatcccaaatcttggtaaaataaatccggcatgtagctaaactactttgccggaaagttttcacagtgtttgtttattgagaatggttaaatgctgatcaagcgtgtagacgattggttgggcattgccaatttcaactttgttaataccagcatcgctaatagcttccatgtacttgactaacgcccgtaatgttgagccatgcgccacgataagctgattcttgccggccatcaaccgcggcgccaattcagcgctccaatacggcaacaggcgctcactcgcatcggcaagactttcaccgcgcggaataatcgtcgccgggtacgcgtgatagcgccgtgaacgactgggatgggccaacaacggcggatgcgcataaaagcttcgccgccagctggcaacttgatccgggccaaaaagtttccgggtcagatctttgttaattccgcgtaaggcgccataatgccgttcgttcagacgccaacttttagtgatcggcaggtaattctggccgattgcgtcctgaacgatgtaggcagtcataatggcccgcgataacacgctggtatgcacatgctcaaataagatcccggtcgccgcaatctttttgccggcagctgctgcttgagctttcccttgcgccgttaatccgacatcggaccagccagtataagtattttgttgattagcaatgctttcgccatgccttaaaaggactaatttgaccacatcacggcctccttaacccaactagtataacaatctcaacgggtttagggtagtctgctcggcaggtcttttttgccgccaaggcgtgaaaatgataggctactattattgaactaagcaaggcgcactgccttagcttatagaaagaaggatgctcatggccaagtcgcatcaatctgtcaccatggtcgagcttttctatgatttgatttttgcctatgccgttgggcgaatggcgcagagtctggcagtgccggtgcatgggatgatcgcgccacaagtgctggttgaatttctattgatgctgctggttttctggaccatctggacttttcagacagtcttaatcgatcgtttttcacatcatgaagtgacccacaacctgtttacgttgttcaacatgttttgggtgattgtcttaagcaccgcgattaaccctgattttgctaaaaccaagtggccatttcaattaagcgctgcgattctcttcttgagtcttgcgagccaatacggtctgctttggcggcgaaaacactcgcaactcgccaaaacatttggcatcacactggcagcttgcagttttgtgattttaatttcgctatttataaaaccatacaccctttcatttgcggtcttctttggcggtgtgctagccgctgggttgatgccattgcttttgcggcacgtactcaaaaccacgccagccgacttaggcaatctcagcacccgttattctctgttggttttactgatatttggcgaatcgatcattggtgtggcagaaaccatttatgccggtctatctttgcaagcaggtcttttcttcttggtagtcatcttattgtttattgcctaccaacttgtttatgacaacggccttgatcgccggcaaaaaaccgcgggcttggctgttatctatttacaacttccattactggcggccattctcagtctcagtacgttcattcactcgtggctggccgggctgcttgatcctcaatggtttgcgcttgccatcacggtgacattggcagtttattattttagcctaatcggatatcttagcgcctatcctgtcaagcacattgacatcggcttcaaacgctggttttaccttggtttttccgtgttgatttttggtatttttagcttcatgacaaccattatgccattacccttcatgttcggactcaccgcttatctattagccaatacgctttatctttggcaatttattctccatcccaatgacgcgatgtataataaacttggttaaatgaaaggggagctccacatgacaacttatgatgtcacattcaacactgtcgatggcaagtcactcatcaagcgcaacgtccaaagcgatcacgaaaatgctcgggtttgggaggacgcggttgaacgttttgatgccgaccacctttacatcaaaatgaatgacaaaacaatggtcagccttttacggcgtgccgttgttcgcattgatatgaccgaactgccaagcgatgttgaaaaacgggcaaatcgccgcgatgagttccgcaatgccatgtacacgctgagccagattggcctgtagcaatcctgttacgggtatcaaaatggatcagcacatttagtccatcagcctctaacccacgtcatcaaaatcctatcgattcatacatatcgtagtttcttgatgccgatccggtcatgctgatgtacagaatctatgtatcaaaaaagaatcccttcagccttaaaaactgatagggattcttttttcggtcgaatcatgtgtctgtacaacaaacaccaagtttaattcatcaatgcttcaaattagtcagcgtagttaaaatgggttaacggtgcatgcttaacatcttcaatcgtcttagtgccggccagctgcatgataatttccaactcgtgatcaatctgttcgaacacgctttgaacaccttgtgcaccacctaaagccaagccatagataaccgggcggccaaacgcaaccaaatctgcaccggacgccaaagctttgaagacatgactgccacgacgaatgccggagtcaaagatgatcggaacctgcttgttaacggccttagcaatggcaggcaaaacatcaaatgatgctgggccaccgtttaactgacggccaccatggttagaaacatagattgccgcagcaccggcgccaattgcccgcaatgcatcttcaggagactgaatacctttaacaataaccggcaagtcggtatattcagcaatccggcgaacgtcatcttcattaatcttttgagcagcagaagcataaatttcgccgatgcctttacccttgccatcgccttcagaatacttttccaggttcggcattggaatcgggaattggaagttgttgataatatcttcttctcgataaccatcaacagtggcatcaacggtcagaataatccccttgacgccagcctttttagcttcgtcaagcaagctcttattgaagtcccaatccttgctcatgtacagctggaacaattgcggtgctccgttgccggccgcagcagtatccgcgattgaggttgagctatacgtgctctgcgccatcaaaccaccgactgctgccaagccgcgagcggtatccttttcaccttggctgtgagccaatccctgagccgcagtttgcgccatcataaccggcgtcttcagatcaatgcccaaaaagttggtcgacaagtctggagaatcaatgttcgacaacgccttgggaacaatctgtgcgtggttaaacgccttggtattctcggcaagcgtccattcatcttcggatccgccaacgatataaccaaatccacctgttggaataatcttcttggattcaccttctaatgacggcaagttcaaaatatccaatttcttctctgcatcgctttgttcgtaaccattaacaactgtcatgtgtcaaaagcctcctgaattgcttacttattagaacacttataagtgtagcacttataaatagtaagtaaaggcattttgctaattttttgtaagcaaaaaggagaacctgcaaaacgaggccctcctttgttagccaaacaccgaatcaacattggcggtttagcgttctttcttctccttggacttgtcaaccacgtcattgaacttctccgcgattttgtccttggcatcactgagcttttctttagcattgccgaccatctgttcagccttgccttttgcttcggtcgattcatcgccggtgagtttgcctgcgccttcttttaccttgccactgaccttatccttagttgcatcaaaatctgccatacgatcatgcctccttatttttgcttaacttaaggataccaagttgacggtttgccctgctattttaatgctcataaaaatataaatcattttgttttggcgtgctcagtcacttaataaagtcgaataaaaaaaccagaccttgatgtcaaaaacaaagtccctccgacatccgtgcctgattttataaaaagcctaacgaagtaatactacaatctgagtaacatcctttatccgttggcgaaagttaaatttgctgaaaactgatccttatatttaggatctcaacagatcagtgtcctaaagtaacctaagaaattgtcacttagaatcctttgaagctttgtcggtcgaagatgtaacccctagtttggcgaaaagcatcacaaccaacaaaatagaaaacactttgacaaataccttaagcgcgaaaaggtcaaggccaaagcagtacagaatgaccctgtttaaaatgtcgccaaggccaaggccgccgaggaaaacacagatactgccccaaaaaggaacttcgtcaagccatgttcgtatcgtttttaagatgttcctagcgtcccccgttccatccctttttaaaacctttaaagatctgatcggtatgtgcccacgcatccgccaataggaaagtagccaaagcaccgccgtaagctgctaaagggacgattcctcccgaaactgacgaaagatctcgctccgacagtggcaaaccagggttaatttcttttaatgtcttcatactatctccccctatcctttgatggctctagctacccctaccgaaccacaaaatggaaacggaaggagccaaccggtcttaacctgacagttagcggcagcgccaacagcataaccaaatttttcccagattaagtcgttagacccggcagcaatcttgcttaaatccaaatcatttaattctttataagcctttgttaagttgttcatgtttttcctccattctttctgcttacactattaacatcgttgtcatcctcaatgttcaacttagctggatgcacaatcggtagttggtatctgcgcattgagctgtgaatcggtaattagtgtgttatatctgaattcagctcacttgaatgaactgtattcccacccgtaactagtttgagctttcatacagtgatcttctttggcgccgtatcttttaaaaccactgcctaaacatcctcctttcgttctttaagagtgatcatctctcactaccaatataaaacattaaagtatgcctgtgggaaagtacttattaacgtcgtattttccccgaaaatcgtcacgtggaattcaaatttaacgtttatcgcaaattttgctacgtttatttttcattttcaaatttgccattgagctgtgttagacaattaggacgaattctgtgttgctattagctaaaagccgctcatagtccttaacattgacgattatttccttctatcgctcaaccccccataacgatagaccatcgccaagaaataccgaaagcagattcattttatgactgagcattaaattttgaaccagctgttgtcaatgtggtttacccacgattgccaactgacgccatttttttctggtcaatgatcaatcaaacgtgctgaccaatatgatcactgtcacggttaactaaaagtagcatgaggactagtgattccaaaagtttttcatctcttatgtatcaaaacaaaaagaccctccaactaacggagagtcttgtaaaaacgcctttagtgccgtgcaccgggacgtttttcctcaggcgctggcggaataaccgctttgccgccttttttaatatgcttgtagttcacaactgtcttattcttcatatcttcaaccattgacgcatcttcgggtgaaaaactgtcaatcgtcaacatggctgcattggcataaagcttttcgaccgtgcctttgaagctcaatggcacatctttggtctttcgtaccgagaccttatcgcctacaacgatttcttgtgacacacaaaaacctccttcaacgcatcttccgccacatttccgtcaccatcgtaacacgagccgtcatcatcggaaaatgaaggcgcgttatgacaattattgaaacggaatcgtgacgcactgcatttcgactgggatagacgcactatctttgcgctgttgccaacgccattttcatcaatagttaagagcttacttggcgacctggactttaaccttaatcggtgcattcaggtcaaccgaatcactgtaatgttgcaacaaataccgctgcatcgcatcacgcgcttctttcttggtcatctggtgacagacccgcgaagaatcgtgccggtgtccccacttatccgtatattgaccaacgacttcataatcacgaagatgtgctgcaaataacatgattcctcttaaccacctttactaattgtaccatgacttggcacttgtttttgtatcacaagaagcatttatacacccttatcggtcccgtttcaaccacatgagcaaaaaaaggctttcagagcttcccagatcccggcatatcaacgctaaagctttctcaccgtttcaacacctatcattgatatgttagccaacatccctttgcattggctgatcaaagtcagactaaagccggtcacggttactctgcttcatccgcttaaacgcaatcaccgtccggcccaccaagtcctgaacattaaacttatctcgggggtcataatccaaaatcgtcaccaaagctgaattctcgtaacatttctcgatccggccaataaaatcatattccatattgccattagcctggcacaaaacagtcattcctgattttgcatgtttcataaccaaaacctccttgtatagtgagcgtgagcagggccgcttagaaaccggagtgtaagtggcctcaggcgtgatggcccgggtttggccattgcgactgaggtccttacacgcaggtttctggccctgcgaatgcgttatggagcgcgagccggcgcggttagaagtcggagtgtacgtggccttaagcgtaatggcccgagtttgaccattgcaccaaggtccttacacacaggtttctcgccctgtgaacgcgtcacggaaagcgcaacccagcacaaccaatattccacctgctcctgctgggttgatattagattatcaaggtgaatattttatcgtcaacataaacgatcaattatacaaatttcctaatattttgttcataatgcccactcctgcaagctcgttcgttccctgtctccagactaaaaattgcgccaacccaaacgccatttatactttctatgattttaagaattcctagtcattaatatttctattgacatcattctaagaaagactaacgcttaagaagcatttaagtctcaaggcaaggtgatgatcaaatgaaccgacacgttttcgcagcaaccttttcttcgctgcgttcaaagaactttcgccgattttggacgggccaatgtatttccgttatgggaacctggattcagcgaacaacgcaaacttggcttgtctatcaaatgacaaaatccgcttttctagttggtttgctagcggcggcacagtttgttccgatcatggcgctgactttggtcgccggaacattgattgatcgctaccccaagcgacaaattcttttgtttacccaattcggctttttactgttgggtgctacgatgacgttgattacctatttgaagatcgtccagtattggcagattctcgcgattgccttgggctatggcatccttcagagtttcgatacgccaacgcggcaatcatatgttattgaacttgtaggcaaaaaagatttaattaatggcatttcgctaaactcatccattttcaatttggctaaaattgccggtccgtcactggcaggtatcttaatggtgacgctgggcgtggcaccgtgttttctgattgatacgcttagttatgtggcgattattgccggtttgttaatgattcaccaagatcatcctattgccagtcatcgttcacgccacatcttattagatatccgggaaggcttaagttatatcttgcatcatgcagacgtgaaactcagtgctgaattgatgctggtcatctgtacattaaacttcaacaataacgtcatcatcccgatctatgccgaggaggttttgcaccgcggcgctcaaggttatgctagccttttgtctgctactggtgtcggttcactggtagcagcttttctcatgagttatcttgccagcttcggcctgcgccgggatctttatttggccgtagcagtcggcacggccttgattcagtcgtccatgctgttcattcatgtctactggcttgccatgctgctcatggttctcatcggcttttgtaacatggttttcctgaaccagtccaacgcctcgtttcaatttggcattcccaatcaactgcgcgggcggattatgagtgtttacgttttgctcaatcaaggatcaaccccgattggtagtctatacgccggcagtgtcatggatgctgctggcggtttatggggatttcctgcatgtggcgtgttagccctcatgttaacgatggtcatcttcggttttcaccagtctacgataaaaaagtgggtatcccggtaacaccaaaaaacgcaggtaagcacgttgaaaagaccttgtgcttgcctgcgttttcgcttaattgttgaactaaccttcgcgtacctgtccgttacccagcacctgatacttaatcgtcgtcaacgccgctaaccccatcggtccgcgtgcgtgtaatttttgcgtactaataccgatctctgcgccgaaaccgaactcgaagccgtctgtaaaccgagttgaggcattcacatagacaacagccgcatctacctgttggaggaattgctgactattttggtagttatccgtaatgatggcctcgctgtgcttcgtgttgtgtgcgttgatatgcgcaatcgcttcttcctcggaatccaccaccttgaccgccataattaagtcattgtattcggtatcccagtcttcttccgtggcgacctgcatgttcggcacaatcgcccgcgcccgttcatcaccgcgcaattcgacaccatgcgcttgcagtgccgcagcaattaaaggcagttgcgcgtttgcaacatcagcgtggattaaaagtttctcggccgcattgcaaacagacggccgctgaactttggcgttgacaacaatgtcgattgccatctgggcttgcgcatacgcatcaacataaatgtgacaattgcccgccccggtttcaatgaccggtacggtagcctgttcaacgactgctttaattaacccccggccaccacgcggaatcagtacatcaatatagccattcaggtgcatcatctgattcgcgacttctcgcttcgggtccgtgattaattgaatcgcgtcttttggcaatccttgtgcggtcaatgcagcctgtaaaacagtcgccaaggccaaattgctgtgcagcgcctctttaccgccacggagaatgaccgcattgccacttttaaaagttaacgcagcagcatcaacggttacatttggccgggcctcataaatcatccccaccacccctaaaggcacccgtttttgcgcaatattcagtcctgcatgattcacccaggccttatccgtctgggcggttggatcgggtaaggcggcaacttggcgaacccctgctgccatgtcaacaattcgctcggcggtcagcaccagtcgatccgtgaacttagccggcaagcttgctgccgcttttagatcttcatgattagctgccaaaattgtttccgtatgcgtttcaagcgccgtagccatggccaacaacccggcatttttttgtgcggttgtcaactggctcaaaacagtcgccgcggcctttgctgctcggcccatttgttccagatcgatcgtggtgacatccatttttaatcgtcctccttgtaccctgacaggcgcaaccgttcatttattaaagactgttcgttcagcaacctctttaaacatcagttagtcgcatgaatttcagatggcacaggctcaagttctgccccgaaccatgtccccactgactcgcctgcaacgactcgcaaaataatgcgtgggtcacgaccactcgttaaaaccatgtgcttccctgctcgcatcatcacttgtgccgccttaagcttcgtcaccattcccccggttccaaaccgggttgaactgcctcctgcaccagccaaaactttagcagacacatgggtaatcgccgggatcaaggcggcgtttgcatggcgattagggtcacgatcgtaaagcccgtcaatatcggaaagcaccaccagtaagtctgctccgatttgcttcgcgaccaaggcggaaagttggtcattgtcgccaaaggtcgtgcgatgatccagttcatcaaccgcaacgctgtcattttcattaatgattggcatcacctgccgcttcagcaaagcatcgatggtatccaaaacatgctgccgagtttgcggataatcaaaaacgtcatgtgttaacaacaactgaccaattttagcgccataatcgctaaacctttgcgtatacaacgtcattaactctgattggccaatcgccgccaacgcctgctgctgagcaatttcggcaggccgcaccgtcacaccaagtttggccatccccaccccaatcgcaccagacgtgactaaaaccagctcatagccttgattcgtcaaagccgccaacgtatacgccagccgatctatggtctgcaaattaaccttgccattttgatgaatcaaactactcgtccctattttgacaactaaccgtttacaatgcagcatccgtttcaccatcgctacctccacttaccgccgattaccagaatattaaaaaagcaccgccttgatcgagacacccgttaaggcggtaccattctcgttcaaagccgtgctttgcgcttttttactatttaatttcgtcaatcttcagttcaagcttggattcgcgagccattcagaactttcagcaaacgtcctgatctctgtgagccgctactatgacttgatgaagtgattgtatgcggggtgtcgggaaaagtcaagcgggttattcggttctgataacatctatacagggtgtatttttaaacaagtctgcccattcatcagatgttggcaatgcgcggagaacaatggcatcatcaacaacttttacaaagagctctctcgtttcctcaaggttaagttgtctacgcattttaattggtatgacaagccgatgtttaattactgactcttaactttaagcagcgtgcttatgtttacgctttgctttgcgtgtgacgaacaaccattctccgaggaaggagccacagacaccgccaacgtaaatccaccacttaaaaggaatgttcgataacttggcaaggataaatcccacactcattgctcctgcaagagcggttgcgaagttacggtgttgtttcatgtcgcttcaacttctttcaatatttagtctttgttgaacccataatttgaatagatgtcattagtctttctactggttaaccaaatagctttccaaagaagctacaatgatgcctattccaagctgcctacgcggtgcttaccttgccacgtgaccaccaacaacagttcttgaacaattatcgttgcacgttttatagcagccggtatatcatcatcgcgtccccagacttcaagactgcatcaattgttagcctaaaaaagatacgcttctcgaatacggctttgctccgcgtttatcaattgttttataaaacgctatctaagcctttgttgatgcagattatacatgaatcgcattttgtgtcaaaaagcatgcacggaatttttgccaaatacagattacataacgtttgacatataacaaaaataagaacctggactcattcatcaaaacaaacagtgagaaaaatagaacgcccgtaaggaatcagaacgttttttcaatttctgatatatttagcaatctaaaatgcgttgagctgctttccctcgtatattccgctcaacaaataccttattgccgctccaccgccacccgtaaggcatagattcgcggcaaagttctgtttttacccacaggttgaccgttaacagtaacgtgtccctgattgacatgaactttaaccggcagcggcaatttgactgcgtatcgttctggcagacgcagccgttcactgtaaaaatgcccatttgtcagctttcccgtcacgccaacaacacccagatgatcggcttgagcaaggtaaacgcccttagttgtcaatggattattaataagccgccactgaccattttttagccgatattgtttccgtccccgaatgtcaaaacggtaaaaagcaaaagcgccgccagtaagtgggcgttggctgccatccggaaagacggccatttgttgaaataatgcaatggtcttttgtgccgcgtgtgtttgcattgtttgccgagctgaaagcgacatcgtttttggcttaacctgacctcttggcagtcccactactgctgtcatcgcaagactcgcaatcagaatcttcataatcagttgttttacccgcatccccatgcctccaaatattactttttaaatatcgtcacaataagtttatcatttcaactaagatgactgctaacaatacacatgttattaaaatggaaacaataagttgtttgcaagctctgccaacctgatacataccccctgctcgaaacacaaaaaagcccgccgtccacagacctatccctgcacaacggcgaactttcttactttctaacattctctttccagattacgcccgcggtcggcgaagatagcgccgagccagatagaaactcagcaatgccaatcccagcactccgacgacaaccgcgatacttaaccacaagcgccagcgatcagcagactcggcggcgtgctcaagtgattcggtataaggtacccgtttgccggtcactaacaggcggtgggagttgatcatatacggggtacaggtcattaatgtggccaaatcgcgtcccggttcaatgcgcaagctctgggtttcatccggccgcacggttttgatccgaaagacctgatacgccatctttttgccgttgacttggagaaagaacttctgccctcgtttcaacttgctcagatcggtgaaaaagcgtttggtgggcaagccgccgtgtgccgaaacaactgtatgcgtgttcttgcctccccgcggatagctagtacctggtaacaccactgccccttgatctaacagcgtgttgttggtggtgtcaaaaaggggcagatcaaccgctaatttcgggataaccactcgcccgatcagatgccgtttcacataggcttggttaaatttctgcctactttgaaacggatcctgtcccggacgcaaaccagtctgggcaagtgcacggttctccgctgcccgttgctcatcttgggcggcggcattttgcttggcttcttgctgtgctgctgctcggcgactggttagtagcaattcattaatagccgttgccgcgaacggatagcagaaacacgcggctcccgcagtaaaaagtaagatgacgaaccagcgtaacagccgacttgtccccgacgctttttttgtcataggccattagactttcttgctggtctttttcttcattaggtgaccgccacccattaagatggccccgatcatcaggaaggcgaagagtccgattccgcctgtcatcggcaataattgattcaccggcgtgttggcgatgcgaatcgttttcgtaccccaagtaccggcaatgacttcaaaatctgttgtcggatcaaggatttcatagccttctggtgccgcggtttcaaccaaggtatatcgccctggcaacagcccttgaatggttaagttggctgtctcggctccactggttttgagtctcgttgccgcgtcttgattcgttgtccaggtaatcttggtcggttggtaggttccggccataccgttaacgccttcaagaactgcatattcgcgcacattgccgttcattcgctgtaagatgaaagtcgcgttggccaaacttttggaagatccggcttcgtgtttgaagaaccgaatcccgccagtctggatttccggaccattgacggtaatcttgctgtcaggatcaaagctcacttcagccgtgttaccgactttttggtctgggatcattttctcattgacgattccggtgtaggcaacggtcacgcgtttgccggcatattgggtcaacaggtttcgtaccgcatcgggatcggtcccgcctagaaagtccagttcaaacccgaatggatagttgtgtgtttgttgccaagctgcgtcattagaactcatgaaggccatttttccggttaatgcctttaaaatgtcctgaccgtcaaccgtgattgccgtcaatgccttaaaagtaaggccttccttggtcatataatccagcactttaaattggttgtacttaaaagtgtcttgactgtgatcagccagcgcgccaatatcatgcggaatctggaactgaacctgatacgtgagcacatcgccaaccgcgacatcatggagatcttttgttgccaccgcttgttcattgatttccgtcagatttttggtaacaagactgtctttaggataaagatgaatgttggtcagatccgatccatcgtcttgccgcactggcagactcacgatcatatctgctgctttttgatacggttgcggggtcacggcttcgtgaaatgcgtacacgctatgccggccattggttttggcggctaatcctttgaatgccgccaagccgtctgcatcagtcgtgacagttgctgcattaggatcctggagattcacatactgacccaggttttgcgatatcatgctcgcagcggttgtcttatcatgattttccagtaattggtaaaaggcgtccgtcacgttgaaaattttaaattgagcgccttgcaccggtttacgcccggtcagtccaaggtcgtggccggtattttgaatctgttcgtcactggtttgttcgattttgtgcagcgtgaaatccacagtcgttgtcgcggcatgtacgggtttgcccgcactaagcagtggtagaaggaagctcatgagcatcagcgctgccaagagactgtgcccgatctttttaaacgttacttgcatgcgtggtgcctcgctttcttatttttaatgaagaagtaagtggccagtagtagtaacagactccctaaaaggacaaagcgtaaattgcgccaatcggacatggccggcaaataaccggattgacgcttaggtgtacgcgttccggtgccgttcgtatcctgcccgtgattgccaagctgggtcgttgatggccccgcggtttgatcaccggttgtcgacgcctgcttatcggcatagttataaactcgcgggtagccgctactgatcatttccggtgtcaccaccccgccaaagttttcctgcatcggctggccgtcaattaacacaaagcgccggttgccatcttcgtcttcccaagaatcaggaatctcgattttgatcgcgcggcttttagcatccacttcatagccgggaacgccttgcaattcttcaaagaaatattctccggcgggcaaaaagcgttcacctgtattaactagcccatcttgatcggaaacaaatttgttcacgcggtcatcatgcaacggatcagtagtgctcacccatttgttgcgcaagtcggttactggcgacatatcgagataaagcttcttaccattctcaattcggtaaatagcaaagatcgcaccggctaaccgtttactcgtaccatcagggtgcacgccgaacttgaagaaatacggatcgcggacataaccgacatttttcggatacagatggatggtctgtaacgggttgccactgataggatccgtgactggaaaaacaactaacatcggcgaacttttgcgctctaagtccacattgagttcggttgaaggatccggtgccacctcgatcatcagataagctttagtcggtgcctgttgatcgacagaaacggttattcggctgatcccatcttcaccgagtgttggatcgttttttgtattcatcagcccgatacctttgttcccttgaccggctaatttcaggttggcccgcgcaaatttcagtgcttgcttacgcgtcatattctgataacgatcaactaaagcccgaattgcttcaggcgtcatattcggtttcaataaggagctggcatcatagacctcaaagttagcaccattcagcccgctggttttgcttaataatttgtagccatctttatccgggttattcgggtcaatccgatgaccgtcattttcataccaaacgtcttccggttggcgaatatcccgataaattcgcttatggatcacaatctcggcagtttgatcagccgcgtgaacccaatgtggtgtgttgccaagcacgataccaatcaatagaagcaacgggacaagccaccaataaaatcgtcgcatcttaacgggcctcctttcgcttcagatacaggtaaagcagccagccgccgccacacgcactgattgcgaccatgagaaacagcaagataccgctaccaccagttttcggtaggagtgtttccaacgaatggttcgtcagtgtgaagcgaatccgattcaacttatcctctgcatcagggataaattcaaacccatactcatcactgcttaaatcgctgccactatacgcaagatctaccattgtgccatgcgcgttaatcttgaaggtaaacgatccgttcagccgatcaaatccggcaggcgctttggtttccgttaagcgataagttcccggggtcaactgatgtgtgaatcgcaactggccattttcatcagtcgttccttgagcaacaggggtggtttgatcgccacggtataaggcaaaacttgcattggcgagtttgtttttacctttttcaattttgatcaactcaagttcggtgggtttcagttggttgatcaccgtggtgtctggccaaatctcgccgttgcggccgactgtcacagtaccgtcagctgccacttttaaatcaaattcagcctgcaactcgtgaccggcagcggcaatttcgcttacctgatagtcgccgggttttagcgttccaaatgagactttaccctgcgaatcggcagttgctgtttgcagttgagtgtctccttgcttcaagacaaaccgactacccggcagcactgcgccatactggtttttcttggtaaattcagctggaaatctgcctgccggatcaagatgaacctgcactgcgttggtttccttactgtaacgttcctcagtgtcgaaaaatttaacggtcgctttattgaccagcgtaagtcgttttgtcagggtgtccggatcctttgttggccgcaccttcaatcgaagtgagaaaaagccgctatgaaaatgaattttctgcacatcttcacgtccgattgtcagcgtgattcgctgccgatcgccttcttgcgtcacgacaaaatccgacacgtcctcagtcagcgtcattttccgatcttggccaaccgcatccggatcagttgcattaaagagctggaacgctttttgataagtcgggggactgttgttattgtccggaatcaactcgacatgctccggtagcaggtccgtcacaacaattttggtcggcttcaccacgtaatcgcccatactgtatacttcctggttgatgtagtagtaaaatggctcgccgttgtaatgctgattgaccacctgatcgtctaaatcatttgcggtccagatggtgccggttttatcttcctcggctccgccaccggcttcggcatttgcgctcacgcttttgttgttggtgacatttgggtcaatcaactcgatttgtccactcccattggcaacccaagtaccgccgccgttggaataagtgccgcgtctaaaggtatgactggtaccgtttaaagtaaacgcaacggcaccacgcccaaatgttggcgcacctagtcgatcttcccattccgtcatattctcgtgatcaattggatcgacccagtttccccaggtctgtgaggtgtacccacgttgttccttcccgcgagcgcccagtttttcggtttcgaatgtcgctttatctgaggtaatccaggttccttcctcaaattgccaatccgtgataaaccgatcgtcataagtgggcgtcatccccgcctgctccgtccagacaaactcaccgggattcaacgaagtaaacgtcagggtcgaattttgattggcttcactttgcggaataaagttcaatcgctgtctcgttgccttgtcataaaaaatcacgcgccagtcatagtacaaaacattggcaaatgacatcccggaaaagaagttgttggaaaaatcaatgccgacatcctgaggggtagtgccccattcgactggacggacgcgaatacctgttagttcaacataagcaccaatctcaaaacggtttccatcaagatcacttgctgagccaacatgatcaatatccactttgatcttggcatctagcaggttagaaggaccactgggattttgaaccgcatctttaaaaataatggcggtggcatcagaacgcgacacataatctgatgaaacgccattctccatcgcccaacgtgatccgtattttgaacgggtactactatttggtttgcgataaatttgcgcctcttcatccgaaagtgcggcgccatcagctttagttgcgtgaattttaatcgtcccaagtgcagacggcggtaaaatcagactgtgcgcatctttgctgagtgcagccggttcctgcacatcatcgttagccaggcgcgcaggcagctgcaagtcaacatcaagcgctaatacctgagcagcgtcattaaatccatccagactgagtttcacactagctgcttgctgctttgtatcaggcagctttttggttaaaaggtattcacctttttctgccgttttctctgcaagccggcgcgttatttcaccgttagtatgtgcaggctgggacgtgaatccttgggcattagcgaacttgacgacttgctgccccgtttgatcctgtggcttggctaaaatcaacttaacctgaatttcagaccgctgaatgtcaacgttgtaagttaacgtatgaccatcgccgtgccaagacttccctgcttctagcttgatgtgctgccgagcttttgaagtagtttgcttggcggccgcgctggttgatggcgcactagccgctgcttccagatcaaactcagcagcttcggatgcggcaggacgagtgctcggctgcactgacgcatcccggacatcgtgctttggattagtctgagcgcttttggctaccgggaccgcggcactgccaatttgcgtgaccagcatcagcagtaacatcagcatatgaatccatttcctaggcaatcgggtgcctcctttcatgttacatttttcacttgttgctgaattaagcgtaacaagatgaactgcgtaaacggaactataataattgttattttataaataaagttttcttcggtatattacttcttaaattataattagcagcgaatatatgaatgatcattccagtatttataagttttaggatttggcgcacaaaaaatcccgacctgactaagctggaaacgctcagacggatcgggaacaacctacgttattaaattatattttgctactaagcgcggacaattttacccacggcaattggcagtgtgacgtgtgcatcatagttcatgacggttcctttaaccgtatctggaagttccaaactgtccggaacaccatgaatgtaaacaacccgtttatctaattgcaaatcttcactaccaaatgctgccttgaacgccttctgcagctcttttaaatccacgagcttgtcataagcatagtgcccgtcagcatcggctactggatagctgtcattgggtacgtgcattttagcaggctcggcatcaaacgggaccatcgttgtaccggaaaccggttccgtttcaggtaaatcaacaaagccgtcaccattagcatcttgggccgcggtggctatctcagctggcttgccatccggaaaaccatggaagtgttcccaatgctggacgtttgcaggtgtatcaaacatctcaatatgaatacgcaactgcgccccgtcaacagtgaactcggcagtaccatgggccttagtaccgatcttctctgcattcaatggcacaatttctgctgtatacttttcagccatgtcaaccactcctgttttaagatttgaaccacctttagaataacgtaaagtctttaattgctcaattagtttaataattatttttatagccttttctacgttctcctagcgatggcgtcaacggtttcattcagtatttaagcagttacatatctctccgaagcgactttattctcttcctaaatcatgcgcttgaagtagtcgctgccgtaacgccggatctgcagcatataaatacaagccatacttagcccgtttcagcaaaatattaatagcattcatgacaatcgcaattttagcggcttgcgtatccgctaaatcagggcgttttttgaatgcttctttgtcctgatattgactcaggttgaccgtcagacgatccttctctgcatcgtagccaagactcggccctaaaataactccggcatagttcaaatcgaacccttgaatcgtgtaaatcgagccaacttcatgtaaggtttccggtcgttgtgcccatggccgatcggtaaaattaattttatcccacggcaaccgcaatgaaccagccgtgacataccaggtcttcttatccagaaccgtaaacggataatcagctgttgcaatcaatcgtgacaggccaacttccgcatcgcgttgctggattaggcgatacatcggctgaccatcggcaaaaacccgaaaatcaaacttcttcggatgtggcagcggggtgatacgcccgcgaacaaactgatcaatccaattattgaccgcagcatcccccacccgcatttgttcagtcagttgaaaatgcgccactggatagccgctggtggttcgcttcagcaaaggcggcgtccaaaagcttttaagtttaactagttgatgaaaatcaaacaccagcacaaccaatcgcgccaattgtaaaatgtcagtcaattgattagtatcccgaaaattgttatacgggtctggcgctgtcagcaacaaatgtccttcgtcaataaaaacaacatcggcgcgcttgccggcttttcgataggcattaataaagggtgtcggcttcataaagtcctttttgcgaaaataggacttggcttcggctatttctttgtaaatcttcaacatttcattatggttcacgagcagtttattatcagtgcctgccagcggtccgacttctgcacgcgcggcttgttgcagttgcgcaaaggccgcgtccaacaccacgcttttcccggaaccggcatcacctgaaacgatgagcaaatgcgttttgtcggcttgataattagccatgataaaattatgaattttttgcttcaatgctgcttgtgcggtggtcaatgtcgcgtcttgcggcaaaatgaatgttgactgagctagatctggcatgtcgacacctccgtcatcaatatagcatgatcaaagctagtgaccatacgcagcttagttagttaactataacaactttaaaaataaccttaaaaaaactaaagtcaatgcaaattacatacgttattcacgtaaaccggttacacttaggatagtgactaaaaatgttattcaagaactaggagtatcgtcatgccttcaattgctgattacccgcaacgcctcaatttagcgccttttcaacagacacgattaactgagttggatgccggtctttttgcacagcttggttatttgaattttaactacctcatcggccaaccttacgcgcgttttgctgatctgaatgatagcaggcgtctgaataaggccactttaacgacttgggcaattccgacgcatcaagcaatgttacaagcgatgcggcaaagtgcacggtttgcgcgggtgacttggaccaattggcttgagacctgcagtcaccgtaatgaagaagactttggtgccatcaccttcaccttggcaccacatgtttactgcgtgagttttcgcgggaccaccaacaagttagtcggctggaaggaagatcttaacatgagcttcatgcccactatccctgcccagcgccgtgctctgagctacttgacccggcaaattagccgccatctcggtacctattatttgacgggacattctaaaggcggcagtctcgccatttacgcttttgacaacttgccgcaaccgcttgctgatcaagtcgcgcatgtgtacagcttcgatgggccaagtggcgtcccactcgatcccaaccaccgtgatcgcgtcaccaagctcgttccgcaaagttcactcattggggtcagtctcgatccggcaactaactttgaagtggttaaaagtcacgtcaaacttttcggccagcatgacgtcctcacctggaatatcgctgaccatactttcgcccggctgccaacgaccacttggatatcgcgctattttcagaaaacttttgcgctatggttggcgggtttggacaccaaagcgaccgccatcaccgttgacgccttatacaccatgcttcgaagcggcaacgccatcaccttagacgatttagccaaaaccaaaaaccactggcgccactatctacatgcctttcatgaattagacaagcatcatcgccagcagctaggcaaatcgttccgctgtttgctcggcgcaatggcaggatcgttggtaaaaacgcattaaaatttccatgtcaacttgggcctgttagcaataaacttcaaaatgtctcttttaactcgaagcgagaacggcaaaaacctgccgaactcacttcgagttttttgcactactgtgacaaaaagttcaaactaacctacatgccgtcagttcgcggcccacaaaaagacaaactagcatccgcccagaaccccgtcatatctacaactctacgaatcttagagtctccctaagcaaaaaatccttgtacctttttagatctgctttaacaatgagaacaggtggtgaagagaaaatgcaatttagtgacaaactgaaacaggctcgccagcaacatcatttaacccagatgcaggttggtacgcaattacatgtttcagccaaaaccatttccagctgggagaatgggcgtagttttcctgatattagcaccttggttagtatcagtgatttatatcaaattccgttggatcaattacttagggaggatcaagatatcgtgcaacattatgagaccatcagcaaacaagctcagcgttaccaaaagtatttccaaattacatactttttgaatatcttactgattttggccatctgggcagtacagatcacttcgagcaattctaaacatatactcgcgtggctatttttggcactactggttaatttagtggtaatggccacccactatcctgattaccatacttggatcaacggtaccgcacaccggctgctgttgatcctgttagcggttggattaagcgcggttttactcgtcttgagtttcaatggcgcagcgtcactaaacgacgccaaaacagcctctgaccaaactgcttatttaatcggcttttatacagggctgctcacaaaaccgctaattgaggcgtcaagcattatcttttccatctttggttttgccgaactaaaagaacagccgtaagctcttttttctcatcttcccgctaagtcagccatttgcgctggcttttttaaaatctgataacttgctttacaaggtacaggctgctgggtatactatgcttaacaaggtatcaaaaggaggccagtgcatgcaaccttcatcccaaatgctcaagggcatcctcgaaggcgccattttacggatcattcagcaaggtgacatttacggctacggcttgcatgaaaagttgggcacattgggctttggcaatatcccggaaggcaccatctacccgttattgcttaaactacaaaaaaacaagctcatcgttggcgttcgccgtcctaccggcaatggtcccgatcgcaaatattatcacctcactgatgccggtcaagacgccttggctgactttcagcaacagtggcaacaacttgcccaagcaatggcacagcttaaccaaggaggcaccgaatcatgaaaaaactaaatcggctgcgaacggcaaacgatcagctgctgaaaaatattcacggcactgattacacctacacggaaacggttatccaatatttacgcggtgctttgttcaaggatccatacgccattgaacacgccattagtgacttacttgcaaccctaatcgatgcacaacaggccggcaatcgcgttgccagcttcttcagtgacgatccccaaacagcagcggataacatcttagccgagttgccacgcgtctcttggtggtacttgtttgatcaatactggccgatcctcatgttccttttttcctccagtatttttacgatgttagtcagtcaagacaaccagttatctttaagtaataccattgcgccgcttactgttgtcttcgcctttttagggttgccatttgcacgcggcgtctcatttaataagctctcggccaaaacaatctttggtctgctgctggttgtcacccttcttgttatcgtccctttaatactgggttacttaaccgtcagccattctgaatttgccttttcgcatacgacccttaccatcatttgcggcagttgtgccgtgctcaacttggcggtggctttgggttttcggcaaatcgctaaactattcttaggctggtcaacgatttggctactggcacttgccggactacttttgccaatttcagcattcacggtcggcattgccatcgccggcgttgtcctcacagcactcttattgttctatcatcccgaaccccgctccggattaatcgcctaaggccgcgattgatcacaaatcatacacaggagaagcattcgccatgaaaaagttaatgaaactgcgcgccgctaatgatcaactgcttaagcaaatccacggtctcgatcataactacacggaaacggttgttcaatatttacgcggtgctttgtccaaagacccttacgcagttgaacatgccatcagcgatctgctgacaacgctcattgatgcctaccaagctggtcatcgcgtttctagtttcttcagcgacgatccccaaactgctgcagataacattttaaaagaactaccacgcgcttcgataagttatcatttcgccattttctggccgttgatcatgttcctgttgattgaaagtatttttctcatgtttatcagccaagatcgtcagcttacggccggcaacattgcgttagccggcgcgaatgtctttattatgattcctatttcttacgggcgtggcatcttctttaacaagataacacgcaaaaccgttttaacttgggtcgcagccttgttcgtcatcttctttgcgcctgcgctaatcgattatttttcacacggtctgctagacttggctatctctcgtccatcacttctgggattcagcctcgtcttaggtgccttcaatctagggatggcgctgtggtttcggtatgctgcccttgtgtatctagcatggaccggcatctggctgatagccgcactcggactttccctccccgtctctcagataacggtcatccttggcatcatcggattcgtgggtgccgttgcatcgtcggtttttcgtttcgagccacctgaagtatgacgccaaagatgacgctgctgtgttgctttatttaaacagctgaccaaagaatgttgcttccccaaaataacgatcgccggttgccccaatcgttgtaaacaattggcttaacgcggcaggtgactgtaagtgattgagtaacacataccgggaaatggtccgtctgagtttgagggccaccatttgataaggcgtatcacggtttaagtctttggccgcctctaaaagctgttgccgaatttctggatgctccgccatttccggatcgttataagcgacatcactcgcctgaaataattgttgcgttttcttactcatctcttcacctcgtccatcttgctactagctggtatatactcaactcagtcattattatcaacgtagaaagtaactaacacgagtcgttcgaacactgacacgctttttgtgctgtgctagactattcatgcagtataccgatcttgtgctcaccctaatatccatgaaccgggagccaaagatcaattttccgtttgcagcttatcatgtcacttatgaaaggatctttcaattgaaatatcgtttattaggcaaaaccggctacaaagtcagtgaagtttcgcttggcacctggcaactaggcggcaagtggggtgcgccattcgatgcaaaagtcgcccgcgaaactttggacgaagcttacgatcgtggcgttaacttctttgataccgctgatggctatcaaggcggtgaaagcgaaaagatggtaggggcattcgttaaagaacatcccgaagtgcatttcaccactaagattggccgtaaagaagaaccgctgaccgccgagcattttgatccggatcatattcgccgctatgttgacaaatcgcgccaaaacatgggcttagacagtctcgatgttgtcttgttgcactgcccgcccatgcaagtctattatcagcctgaaactttctttacactggatgccttgcaaaaagccggtaagattcgacattatggcgtcagcatcgaacgggccgaagaaggcattaaagcgctcgactatgacactgcggttgttgaagtcatcttcaatatgttccgcctgcgcccggccgacaccttcttcccgctggctaaacaacacaatgtcggcattctcgcgcgggtacccttggcaagcggcctcctgaccggaaagttcgatgaaaagacccaatttgcccccacagatcagcgcgccaacaaccgccatggtgagcacttcagcaaaggcgaaactttctccggcgttgactatttaaccggcgtcaaagcagcccgcgaactaaaggagcggttaggatctgacaatctggccgcaacggcactgcggtttattctaatgtacgatgctgtttcagcggtcattcccggcgccagcaacccgacccagatcgaacgtaacaccgacgcagccgaaatgcctgccttaacccctgaccagatggcagtcgttaaagatgtttacgagcgcatgatcaagaatccggttggttacgagtggtagtcaactaatgatcggtgagcggttgtcaaatgaacctcctcaccgatttatctaagtgtaagctgactgtacaagccatctgagtgtgatgacgatcacgcttgccaagttggtttgatgcttgcgctaactcgttgctgccggcagctttcttctgcaacagcgctgttgtgctacataacaacttaacgagttcaccgaaaagcacccacacttccaattgacgattcaagtcataaccatcacaaaaccccactccgatttgaagtggggttatttgtgttgctaaaaagttatactgatcaatcgctttgccgccagcgagaatccataatcaagcgagcggtaaacaagcccaacggtaaaaacataatgataagtgcggcacgcgtcatccattcggcaccgacgccaatattattcaatccaatattgtaaactgcccgatagatatacaagccaggtaccatgatgacgattgatggcactgttagcgaaatccgcggatagccatcaacgcgattaatcgccgatgcaatcagcccagccaccagtgcgccgataaatgccgccgcagcagggggaatcgtgttgagatccaccaactcaagccgtaacgtattcgccactgctccaatcaacccggcctgaattgccattcggcggggactgttaaacatcaccgagaatccgaagaccccacaaaagctggcaatgaggcgataaaccaaaagaaggaccggactcaagcctaagtcgacaaagttttccgggcgtaaatggacaaccatcgcgaccagccaaccaaccagcgaagccacaatggtaatcatcaacgcatacagtagtcgttccattcccgagcgcatatcctgcttcgaaatatccagcatactggtgataaacgggaagcccggaatcacaaacaacatggcgccgatataccccgcttcatgccgcgctgcaattcccagtcccatttccagtccgcgaaaagcgataaaataaaccaaacaggcaaccgccacactgacaccgatacaagccagcaacgtccagttacgtcgaatcatgatttcacgcagccaattaccgatccctgcaccaacaaaacaacagatcatttcgataggaccgccgcctaacaaaaagacgaaagcgcaacacgccaaagcagctgctaatccggcgcgcaacggatcgtaattgccagacattttttgaatttgatcaagtcgatggtgaatatcccgaacggtttgagtcgcatactctttgtcaaaatgacgcacaaaacgttccaacgcatccaacttgtcagtattcacaccactttttggcagtgaaagcacctcagaataggcatggttattgctaaagcaggtatacgataaggaaattaggccaatatctgctgagcacgacatccgcaatgctcgagcaaccgtgttcatcgcctcacgcacgcgccatgccccggtgccacacgccagcaacatgatcccgactcggccgacgagtgacgcgcgctcttcaagggtggcatgatccgcttgccgctcttcgctgacaatcacgtcataccacggaatttgcatatgatgtttttctgaaagcggttggtctccccgatccgcttggttatcttttgccttcataactcgtgctaatccttcttatagggattgtctttttcaaaaaaattgaaaataaacattcactattctagcacaattcataacagggtgtatttttgactttttgaaactaacggatttgaccgcgttattcatgacaagcacgcacaaactagcaatcatttctcggtctcaacttattgcatatgatgttggaatcgctgcgccagaaaatgccggattcgcaaaaagcgacgaggatcttccttcttctgtccattggcaatccgtcgtagttcgtcaattgcatcgcgtccttcttgactcaaccgtacactttcagtcgtgagtataaaatcaattcttagtatcatccgaaaaacatgccgtcgtaattcatagccatggaaaccatcgcggataatctcttccttggttctttccacaacttcttcaatattcgtttggcggatgagctgcggttgttcatgtaattcatgcaacaggcagtcgatatagccttttgtttctaattcttcctcgtaatccatacgccgatcaccgcctttcatttgattaacttgatccgtatcgttttttatggtcattttcttaaagaatgggcatcgcattttcgctactaaacggcaaaagtggtaaataccgatttatcgatggttaaacatcttatctgcaaagtaatcccaataagtctttgtgccagtgataacagatgcttggccggctaatccataataaagcgactgccgctgtgatttagataatttcacccgcgccttgaccgtaaagaagttaccaactttcggatcgcgtgtcggggcaacgtcaatcgcataaacccggccatctaatatggtaggggtcggcacattctcagcaattcgcaggcgcactttctgcccacgcttgatgctcatgatctctgtcggcaaaacgcctaattttatgtcagcggccgtttgttccgttaaatccggcagaattcgtgccaacacgcttcctgaagggacatattgattccccgctaaagcagtttctaaatgcaaaaccccactggcacttgctttgacatgatagttttgagtttcatcattcagggtggctaacttagcctcgtctgcttggatctgctgctgaaccttcgtctgttccgcaacggctgtttgctgcaaccgactttgtaatgcggttagattagcctgagtctctcccgctttttgagccgatacatctgcttgtttttggccagcccgctgctgctctaaagacgtcaaattggtttgttcctcatccaactgtgtctgtaactgagcgaggtactggcgtttaaggttcgcctgtgcctccgcgtcggtattttttatctcactttcatattgttgataaaaatagtgataggcgtggcgactgggcaagggtttgttcgcctgaatcgccgcttttgccccggagatagcggccattttcgcttggctcgtttggatactggcgcttagtaaccgatcaatctctttgtttttttcactagcgacggtttgggttgcctgctcagcctctgctgtcagagtcagcactcggcgttggctcagataatcttgcacctgttgttgatagccgaatcggtctgcctttgaaaaaagatctttgttttcggtaacactttgtttcaaaacatccaattgctgctgttgctcttttagcgttgccagttgctgcttgagtaatttaatttgtgttggattggcgacatcgtggtaaacaagtaaggtctcgcctttcttcacgcgcttgccttctttcatgcggttcgagacgatccgattggcggccgtcgcctgaactgtcacggctgcctttaccggttcaatttcggcagctgtcagcacagttacctcgcgccgagcaaagatcagaaacaatagcaagcctaagaaaagaatcgtactaggcataataatcattgttgaaaaattgcgaaagcggtgctggtaatattcggtcgttgcaagttttttgggatccatcatctaaagctcacctcactcatgaaccaggcgcgcgtaataaccgtcttgggctaacaacgttgcatggtcaccttgttccacaattttgccatgatccatcaccacaatttgttcggttttagccgcaatagttaagcgatgggcaacaaaaataatggtccgatccgtcattgccagcaagcgatcgacaatttttcgctctgtaatggtatccagactgctagtcgattcgtcaaaaatcagtacttttgccggcgataacaaggcccgtgcaatcgccagccgctgcttctgaccgcctgataaaatgctgccgctttctgacaatttggtctgccactgctgcggtaagtttgcgatgtctgcggcaatttccgcagccaaacacgcctgcgtcaagtcttgttccgaaacatccgaacggctacctaacgtcaaattctccaacaccgtgcccgaaaaaataaatggatcctgaggtacatattcaatatattgccgtaatgttgtgagattaatgtctttgaccggaatgccattaaacgtgatggttcccttatcggtatcaactgggtaaaagccaactaataattttgctaatgtcgacttaccagaaccactcatgccaacaatggtatatttagcattttccggcacttcaaggttgatgtttttcaacacatcttggccaaaaccatatttaaacgaaacatcccgaacacgtaacggaccttcgattaaatgccgctccgtcaagtgccgcggttctttgaattccgattcaaccagataaacctcattcaaacgattgttagcaacccgcgccatttgtaactttggctgtaggttgatgatgctttcaagcggattcgtaaagtatgacagcagcgcattaaaggtcagcatctgccccaaactcattcgattggcaatcaccaaacttgccccaatccacaacaccacaacgttcaacgccagcttcaacaggcctttaatcgcttgctgtaactgatctgccttggtgtaactaaacgacctcttcaaataggttagaaattcccgatcaacccgttcatagctaactcgttcgccggtcaaggacttgatggtttcaatgccattcaaatcttcaataatcgatgaactcaagattgcattactttccatcgtctcttgattcaaccgatcaaacggccgctgaaatgcaaaaacaatcaccaagtaacacggcacggcaatcaatgacactaaaaacaaagtcccattttggatccctagaacaatgcctaatattaggacaatccagacatccaaaaacaacgtcataatcgtattcgccagcgcatcaataattttattggcatccgcaaaccgcgacacaatctctccggtccgccgagttgaaaaaaacgacatcggcaattcatataaatggcgcacataccctaaaatgacatcaatcgcaagccgctgccccaacaccgccatcaaaaaattctggccataagtcaacacagcttgcagcaagtaagccaccaaaaggccactagcaatcatccccatcgtcgtccgcatggcattcggtatatacgtatcaataatagactgcaaaaaatacgacccaacgatactaatgaccgtaatcaataccgcggccagaataatgttcgcgataatacctttttgcttagccagcatgggtacaaacgcaaacaaactgcctttgtcctccttacgcggctgatactgcggcgccggtgcaataaagatggccacacccgaccattctttttcaaacacctctcgcgaaagccaggtcatgcgcactgacgggtcaggatcgccaatcagaatactcgtgcgcgttgctttaaaaacaacatagtaatgaagcaattcaccgcgcttcagcacatgggcaataaacggataaggcacatcctcaagatcaaacaactgcatattcgcctgcaccggtttcgtctcaaacgctagtgcttcagcggcccgaacaattcccaaagccgtcgtgccatcctgatttgtcttcgctaactcgcgcaagtgggctaacgaatagtccgacccattgtatttaagcagcatgtttaacgcagccacaccacagtcacgctcgtcaacttgtgcggtgtagaagcgtttgtagtaggtgatctggcctagtttgggggtgtgtttaaacatgtaattatctccactttaaaaattgaattgccaattgacatcagcctctccagaacaaaaaataagtaaaagcactatattgactaggtaaattgtgctatcatgcattttatcgagggccatagcagttatattaatataaaaattataaatatatgcaaatttaataatttttatattgtgtagctcgcaatacgagattatttgtaacctcttttacgagtgctcttctcccacacgtaagaaaactagccaaagatactcgttagccagttcttaaacttgttaaacgtaaaaccttcatctcggagcattccgccaacaaaacttgaaagttcaagatctgtcatcattggcatttcctcatctttaaattttttcattacctttttctcccttcgttttgtctttcgttcaaagtgatcgtaccagatctttaaaaattttggttaggcaaaaaataaacgtagctttttcgccatttaacgcagattttcgagcaccttggcaatttttaggaagttaaccgcctacaaacagaaaggtaaagattatagcatgattatttctacagacttgtattacttcttgtttcacttaccgatctttttgattgatcttactttcctttcgtatatttactttaacgacttcaaactcaggcatattttcttatggtcactcgccgcaggaacgctctccacatttctttcatcagttggtgaaataacatttggtattttatatgcaacaaatatttcaaaaaaatatcagcgttttgatatcttctgggttttcttatttctagaacttaacttaattgttattaaccttcaattactagtcactaaaatcgtatttctgtttctatctgtccaatcatccactatctcaaatagcatcaagctgatcattgatgtcatatttgcagttgtcatgtctcaggtgttaatgaaaaagaagctattcattaattctatccgtgaacaaatccaaaaaaaaatagctatttggagaccggcagttatttatttaatagtgacctgcgtttcgctttactgtttagagtttgctttttcatttcttgaaatcaccaatatcctaacacttcttattttgttaaccttaattctttttatggttatcaacgtattctcgttattcttcatcgtaaaatcatatcagtattctttggagttgttagttatcaagcacgcggaagcttcaaaacgcgcgtactattcagcccttgagcagcaacgtatcaataccagtaggattcttcatgattacaaaaacttacttgcaacgttacagcttagcttgcagaaatcatcaccacaccactcatcagacgttcgaacgattgtcactcaagcacaggatgcacttcaaaaagctgagataggcaaagatgccttagctttgatcgaaagtgatccgctcaggagtttgctgtatctcaaatggtccgaatctgcaaaccgtggcataacaatgtacatgcataccaaagatacagtccgatccctggaaagtgatgtcggatttgcaattatcagaatcttgggcattttaattgataatgctattgacgaaactgccacacttaaacttaagtctttcagagttctcttattacccgcccgcgatcacttagaaattgttgttgcaaacccgattcctgacggctttgatttaactcgacttaaccaaaaaggatttacaacaaagggctcaggccacgggcaaggcatgtccattatcaatgacctaatccaacaaaatcccaatatcagcatgcgtaaagcaattatcaacaatgatcaattaaagatcactctatttataggaggaaaagcccatgcctaaaaacaaaacaatcctaaacatttacattctcgaagacaaccctgactatctaacctttatccaagaaactgtgcagcagtaccttctgattgaagaactacccgccaagatccggctggcaacaacgtcagcaactgaactgcttgcagctgtcgattggtcagccatcaatgatagtatcttcctccttgatatcgagctgggagattcagcgacaagcggcgtagatgtagccacagccattcggagaaagtcatattatgtcgatatcctcttcatcaccagccatgtagatgaagctttaaggattttagagcacaaaatcgcaccgttggacatgatcaacaagaactcaccttcgaagacagaaaagaaaattcgaaataacattctttatgcaataaaacgtttaaaggcgcgtcaggtcgcatctcccagattgtttaactacagcatcaactccagcattttttcacttgaaatggatgaggtcatctatattcaaactgctcccggcgtctcaggaacactggagcttcatgcagaaaatgaaatcacaacctttcccggcaaccttaaggaactagcgaccaaatataccaacttatgtcgatgccataagagtatcctgattaatcccgcacatgttttgcgtctggacatcacaaaccgattcgtttatatggacaatcaagataaacttgaggtcagtattcggagaatgggcgagttgcgccaggctcttacagcaagctctgaagcacctacaagtagtgactgaaaatgccattgtttttcccgtgtgcaaagttggctaatccagcctctagttttagattaagtgacaacttttaactttgccaaggcagccatctaatactgttattagcacttagcactataagtatcgccactttcggccatcaaaatgttagtcaagtgccaagtactctggtgtgtactatcctgaaaccaagaaacctctgaaactaatgtggtgagctcacttaccacactggtttcagaggtttaattcttggcaatagggtacctttccgaacattccggaaaaattgatcaacaacattaatacaatccttagtccctgacaagcatgacttcattgattgactacatcattttcacctcaaccaaacaggactcgtctttcgatgacacttgagctatttaaagagttacactatagcatcaataaacgttgattttcaccaataaacgttgatttttaaattgcattgacgttttttgccaaaatagcgacgttaaaaaataattgaactaaaattctttccgctaagctatagtagagccaagcggtgatcacctacaaaataataggaggtgctaagttaaagtctgcagcagatcatcttcgaagttcggatcatctaatagaaaagcttcgttatctgccgtaataactcaggggcttttaagaaggcacatgttaataaattatcttttaagcttcaaatgagtggagattcagaaaaaacatcaaaggcagcgatattggcgatcttatcggatgtgttcttggaacagccgattctgctggacttggtttcctaggcagagttcgagccggtacagttacggttattggaactgtatccggtggcgcacttggagactggtctggtggagacgctggagccgctagcttttgcaagggagtgtgattcatctgcctctttctctagcttttctcttatggttagcaatgataaatgtctttaccacacgtaatgtttggctctggatcgtcaacctaataggtttgctaggattatgctttctggcaactaggctgtataagaagaacagttgagaaagacatttttcagacgacactaacattatttaagagttagggtctaaagagtgaaggttgaacatccgtagaagccccgagaatcggggcttttttgggatcaaggaagactcgtgagtccacgttttatgtaacctgagcttctaacagcgcctgcaaacaccaagatcccccctctatgcttgtcctatcaactatagcggggggatctttatatctcaaaccagccatgtactccccgttcagattgttatcagcaaagttgccaaaaagataagccatgttgcgtaataaagattcacagtgctactccttcatcagctctacttcaaccaacgtgctatcgactgacccgtttccagcgtcataaatcccctttaaaattcccggtgaaaagtaccaaaacgccattattaaaaccccaatggcgacaagcaacgacactttctgttggaatgataatcttgcaaattgatcgattacgctcacctcgtttacaaacagacttatttttacttctttcagcaatccattagtaacctgttctttatgttctcccaccttctaagaaaaaggcaatatactaatggccaactgcatcaattgggaacatttctcccaaaaagatgttcgcgcatgaagccgatgtcttaagaggtctatcatctgccagctgatcgcagttacaaatacgaatgtgaagaaaaatgccagaatcaaaagcatagaatataacacaactgtcataagcaaagctccttgagttttcttttaaacttacattgaagcggcaaattagcgagcacaggttcggagataccatacgttctgctaaggtcggtcatacaagcaagaaatcacaaaaatgacaccattttagctatttaatgctatttccgaaaggccttttgctgtcaggaagaagaaacaatcgttggttttgaaagctcatcttattagcatctgttctgccgtactcacgcgcaagatctcctgatttgtatttttgtttcaatacaaatcaggagacttttgcgtttttggctaatagaacataaggtaacaagattctgacactaaaagcagtttccaaatatcagtagagtcacctaaaatttcatttaccgtcatgaacagccgatattgcattattctggcctggcagatagctgtgtcacaatagttactgtctccttgagctgacaggcttcctactgacaatgacgctgccaccttaccaatacttcgaaatcaaacaaggaaaatttgttatttagagcgtttatggtctttaacctttgaagatgcgacacttattttggagaaaagaatcaaaacaatgaagattgaaagcatctcaatgaacgcccggacgatgaaaaaatcaaaacccaagcaatcgacaatcagcttgtttaagctatcactgagcgagaacccgccgaaaaagatacaaacgataatccagaaagaagcttcattaagccatgtgtgcatagttttaagaatcgtcatcgtacctccgctttgctcatcactaaatcatttatcgaccgatcagttttggctctgtctttttaagttagaccgttatattcgaaactagtttgcctaagtcgccgttataaattggacaaccttttaggcatcatccattgacaacaagcccataccaaccagcatcgcaatcggagtttgatctgcaccaaatgaatcagtgaacctaaccataatcaagcgcgctcaccgttttagtagtggcttctagtacccatatctgatattcgccagcgaagaaagctgctcgaatttatcagattgttgctcggttaacaaaatattgttttgcaacagggcattagagatttctagattcatgcggcttaaaataaatggaacagctgcttgcttgtgaattaaggcctctctattgttccttagcactgtccgtaagcgatcactatgggaagaactgtcatctaagtcgcgaagcaattcatcgataagctgtatcgcttgttcagcccgtgcattcccaccagaaaaccatttcaatttcttcatctttcactccaaaaaagttgcgctagtgcaccttcacttgtaacacgtttggcgccgtgcattgccagatctgccgtagcaatgacggtaagaacatactcgcctacagataaaggcttgttctgggcagagatacttttacaacggcgacaacgctaaaaatcaacgcaccgttattacgatcgttcccatccttgcttgaccccagctaccagctcatcagcatggttccacgcatctgttgccaggaatccaagaatagcagcgacagggattgcgagcggtccgataccgccggaaatcttactcaattcagcttcattcaacttagtcattaaaattacctccttgtatttgtaagaaactactcgccagttgatccaaaagtctttgttatggatattgtggcgaaaaaatgctcatctaccgcacaactttttgcaaatacaaccatggcgtcatcagcggcatgcctggattaaagccgcttgacctttaccatcgaaattcgactaatgggtttgtatggcagcattacagcgtacggcttaggcattgaaatgagcactcaaagtttaagcgtaggtaataaaccagatagcattcaaaatataagcacgtttaaaggctatctgatgctcactgtcgagatatttatcatcccaaacgcgatagtgaccatcttttttacagcacgtatataccaaaacacctaatagatataccaagataaacgtagctaacattaaaagatttatcttattcatacgttcgcccgttcgagtgcctattcatcccggatactaattgccgttaagtttgtcaacaatctctttggcaggcccaatggctggtgcaaacatggcgccttcagcccaagcacgcgcggttgaaccaatggccttcccgataaaggtccacagattaccattatcgccaccagaaatgcttgctaagtcagctgtgtttaaagtttttaaatgatccatgttcttcctccttttttctttatgagcctgtcaatgtattaatcagcctaagttattgcttaagtcgccaccttaattggatgaacaatcggcagtttatacttaaatgccgattcgtaagctggcggatggcgttcgtttggtgaatccacactgcaattaaataaaggaacattcccgccggtcgtcaattcaagcatttttcccgagatttccttcaaagctagtcctgttcgcatggtcatcccattttcctcctttccctttgttagaaggacttcccttcttccccatcaatataaagtagacagccaagtttgtgggaatagattttttaacgtcgctttttgcaagaaaaccgtcgtaaaaaaccgaattttgacgtttattgttgaaaagccgacgattatttggatattaccgttttctcttcaaaactcaagcaactgcaactgtatttacttttacccatgtctttttcgccactgtgagcatccagtcttaagccaacttagaaaggcgatcaggctcgcggccagcatgtgcatccattcgccggggaagtgatgacaaactgcacacatataaccgacagtaaatgttaataagcagcgccaaaatcttttttgattcacgctttcttctgcttttcctcccgctcactcaacagcattaataacgtcatcaaaatcagcattggcgtcacaaaactgccatgattggtccatccaattgccgatgtgaccgtataaatggcgaaaataatggtagcgattatcaacccataatcgactagtttagtcagtcgcgtaggcatcgtttttctccttaaactcgttctatcataattgatacagacagccgcgctacgaatgcgataaccgtgccagaaactcttcattgttttggccacggcgaaaaagtcgcagtgcaatcgctaggtaaatcccggcaataaggaatgcgtgaacaatcgtcatcgtcatagcgttgggatcactaggcgcttctttcggatacggtccactaaccaaagtgataacaaaatcaatcaaaaaatggatcaatattggcataagcaacgatccatagcgaatataaagtgctgcaaaaatagcccccatgccaaatgcctggatcacttgggcaattgttatcacaagcccttgagcaggcaaattactcaggtgagccaatgaaaaaacaagactgcttaaccctatgcaaaataagagttggtatttggcatggcgatgatgggcaacataaaacgcccgaatcaaaccgccaagcatgacgccacgaaacaaatactcttctggaacagcggcaatggtaccaatcacagctgcttgcaagacgtcaatcggtgttcgacttgtaaccgtgaaccaaccgataagcatcaagatcagtccccagatgacaaccggcttcaatcgtggccgcctaagtgtcactttcaagacgatagcttgtttcagcagcagccagttaagtgcgatcatcaccagtaaaatgatggctttaaataagatattcccagcccagaagtccaatttaagcatgtaaactgctggaattaaaagcagctcgctgattagcacaaccaaaagcaagatatataaaacgcaaaatcctggcgacaacagcaaatgacgttttctttccatttatccaccttcactcgcatgtttcaatgcaacgcagcttcgatatcgctatccacaatataccgaggctgcgcatgttacggatcattaacttttaaacgtcgggttttcgccgataatcgttgtattttgaaacttgacaacgcgttaatcgtccccatttccgaaaaggtttgccaatggaagcgcacttgctgactatttactgactgccccacagttgcacgatcctgaaaatgccgtaagcaaaatcgcctcatccaataccaacgcgccaacgttagtcttgaatgaggcgatgaaaagttagagttcgatatttacgcttctgcggcttcagccaaatcagcaatgctcgtctgctttagcacttgcaccatagcatcttcggcttggtttaaaacattggtgcttgccgctaaccagctcgtgacgcgctcgccgttgacaaacgcagctggatcgatttcctgatgaagcttaaataacggtgccgtcccttcaatagccgttaagatttcgtaaactgtaatcgtttgcggcgttttggctaatcgcaaaccgccattgagaccggttttcgacgttaaaataccactttttttaagtgtagacgaattttttttaatgctaggaaccggaatgtttagcatttcggaaatcttttgaattgataaatagtcttcgtgttgtgcttgggactttgcgttgacgtaggccgtgatttcaagtgcttgcgagaatgcgacagaaaaagccatcgaatatacctcctattagacgattgtgtatattctattataccaatgataccgttacttggcggctttttctgccggaataatgaacgtgacgacaagtatcaagccaacaatggtcatgccgacgccaatcaacattgcctgtccgaatacatccgcaatcttagttaagctgctagttgaagccgcaaagattgccagtcctaaagcgccgccaaattgtcgggcggtgttgtagacgcctgatgcagctcccgaaatttccggccgaattctagccaaacctgaagtagcgagtgtggcaaatgccagcgcgaatcctaccgcaaatccgagtgtcccaagtaacaaaaaccagtaattggcaaaccgtgatgccactgccagttcagccaatgaaagtagcaccgtgacaaatccgaagatcatgacccttgaattacgccaccgatcaacgaaggtccgggccttgactgccacaatgaagagtaagatggccattggcaccatgcctaatgcagtcataaatggcgttaatcctaagacgccttgcataaactgaggtgtgtagaaccaaaagccgattgcagcggcactaaacaacaaagaactgacataagaagccatccgttccctatccgtaaagatttccagtggcattgtcgggtgagcaacgcgaccttgactagcaatgaacgcaatccaaagaactgctgaaatcagtaatgtggggattggccacggactgccatccaacccatatgagattgaagtcatcgctaatactgacaagatcgtaccaatccagtcaatctttccggtttggcgttttgcactaggtaaatatctagccgcaataccaaccatgattaatgcgatcggaccattcatgtagaaaccgacccgccatgacgcaaacgttgcaaagaagccgccaatgactaaaccaaccgctgcaccggctccaatgacggaagcatagtagccgattgcccgctgtcgtgcttttccttgaaaggtgtctgttaacaaagccaaacagttcggtgcaagaatggccgcgcccacgccttgaacagcgcgaaagctaatcatgacaagcgcattggtagctgccccgactgccagactgccaactccgaaaatagctaaactcgcaatgaacaatggtttgcgtccgtaaatatcgcctaatttaccgcctactagcatcagcccagcataagttagcgcataggccacctgcacccaagacaacgcgccagcattcaaatgcaattgtgccgccattttaacggtacccgtgtaaacaatcgatgtgtcaagcacacctagaaaagccccaatcagtgccagacctaaaataatgacttgagtcgctgacatgcgctgcgattgggtgattgccgcatctgtttcctcaatgacggtgtcgtcagccaggccatcattgattaattccttgtcttcttctttgctcatatgagatgcccctttctatggttcacttagtatattccgtttatactaatatggcaaatcttttttgagcaaaaaaaaccacgtgttccttaattctgtggaaacacgcggctacaagcgaattcttttcgggccggttactggaatcagaccatggcttgggcaacaactgtctaaataataaagtgcggcccgcctacctgactcaactcgccatgaatgtcattttccataaaatcttttaccgcctgccaccactgattggcctccgctgaaagtttcattccttgcaagccgattaatcgcgtaaaccgtgcgtatagtcgcgacaaggcgtaatctgcggctcgattcttgagcacattaggccgctttaaaatagctaaggcctcatccacaacttcctgtgcttctgtctccatcagaccaccactagccgcttttttcagactcaggtttaacccagtcaaaataaacagaatctgatttcgttgcaccatattcatgagcgatcctccatgtctggtcgataagtatttgcgttgagatagcgttttcttgaattgctaactgcaatataccaaatctatcaagcttcagggcaaactttcgataaacgtagccttttcgccgattaacgttattggggacataaatcgcccggtccaaagcgcatagaaaaagccgtggtgcattaaccacgactaatcggaagcgcgtatttcagcatagtcgtaaaaaggctgaaatgacacagttcatcagcatcgaacaagctcatattccatccggctacttaatgtccgccaccccagacaattggaaaagcgactagcccagcagccagcgcctgatcgcgataacgcttggcattgacctgatctgccggcacatccgccttgatcgcattgaaaatggcgatcatctcggctggaatcgcgtgatgaatgagataatacttggaaatatcatgcgatagctgggtcacgactgcgacataggctgttttgtcctctgcatcttccagttgtttcgcgttggattcgattatttgctttaatttggcatcagctttcacggccggactactatatgctttactcaacatttcgaataacgcttgtttcttgtctgacatgacatttgcctcctaaaacgatagaccctgctaccattgtacagttgcatcaaggaatttttccagagtatgcacctggacgagccaaaaatcaagcgccatctactgcaacctgattaaagccgtaacgaaaaagaggcacctacatgaaaagtgcctcttttgtcttgaccattacggcaaatcgttgccagccgcgaagtaaatgtcataccattcctgccgcgtcaaggtaatatcggcaccttctgcactttctttgatgtgttcaggattcattgaaccgagaataacctgaacgcccaccggatgccgcagtaaccacgcaacagcgatcgcatttttattcgtgtgataatgatcggcgactttttgcagctcgtcatttaatgctttgaacttgggactgtcaatgaaggtaccttcaaacatcccgtactggaacggcgaccatgcctgcaaggtcatatgtttgcgttgcagatatggcagcaagctcccatcatgatcaacagaccggtcatcggccatgttggtatgcatgcccgcatcaaccatgccagtgtgggccactgagaactgaacttgatcaatcaaaagttgttgatgcagattctcctgcaacagcgcaatttgttcgggattgaagttagaaaccccaaaatgccgcaccttaccgctttgctgcaattcatcaaacgcagccgccacatcatcaacttccatcaatggatccggacgatgcagtaaaaccgaatccagatagtcgatttgcaagcgctgcagaatgttatcaaccgctgacaacaggtgttctttggaaaagtcatagcgtttgccgaaaaccaagctgccgtgtgaacgttttggatctaccacaatcccgattttagactgaatatacaactgatcgcggttaactttagcttgtttcaaagcttcgccaaaaacctcttccgacttgccttgaccataaatgtccgccgaatcgatgaaattaattccatcgtcataagcgctatccaaaaccgaagccgctttttccggagacaaaacattcatccgcataattcccagtgcaacactggaagctttccaattagaaccacctaattgcacttgtttcatgacagcaaaactcctttcttagtaagcgtgagccagcgcgcttaggggccggagtgtaagcggacttgggcgtgatggccgggctttggccattgcgaccaaggtccttacacgcaggcccctgcgctggcgaacgagttatagcgtgagcgcgagccggcgcgcttaggggctggagtgtaagtggccttgggcgtgatggccggctttttggccattgcgaccaaggtccttacacgcaagcccctgcgccggggagcgcgttatggtgagcgtgcgccggccacaacccccagcgccaccgtccgcccacaatccaatgacacctcaattctatcccctaaagtccacttaaggtcaagctaatatgagaatttcaataaaacgacttgtcagcatctttttggcgcgttaatttaaaggtgataacacttatttttaattagcagaaactatcaggagggttcaaaatgactgttaaagataaagtcgtcgtgattaccggcgcgtcaagcggtattggcgctgcaaccacgcaggtattggcacaagccggtgcaaagttagtgattggcgcgcggcgtgaggatcgccttgccaagttggcggaaccttttggaaacgatcagattcgttaccaagcaaccgacgtcacgaatcaagaccaagtcaaatccctagtcgacttagccattaagacatttggacacgttgacgttttgttcaataatgccggtcttatgccgctttcagaaatggctgagttgaaagttaatgaatgggaacggatggttgatgtcaatatcaagggcgtcctttatggcatcgccgctgttttaccgcatatgatcgaacagcacagtggccaaatcattacgactgattctgtggccggtcatatcgtgcatcccggaactgctgtttattccggcactaagtgggcaattcaggcaattatggacggtttgcgtcaggaacaggccgccaaccacattaaaacaaccatgatttccccgggcgctgtgaatactgagttgttcagtaccatcagtgatccgaagcgccgcgcagcagtagaagccgatgagaaaaataacggactcaccgctaccgatgtcgccaacgcggttttgtacgccattgatcaaccagacaatgtagcggttaacgaagtgctgttgcgtccggtcactcagcagcgttaaacgcgttgaatcttttcaaaggagtttatatgtctgattatacttttctaaaaccttttacattcaaaaatcagcccatcaccctgaagaaccgcattgtcattccgccgatgacgactcggctttcttttgaagatggtacggtcacgcaagacgaaattgaatattatcaaaagcgcgctggaggcgttggccttttcattaccggaaccgccaatgttaatccgcttgggaaggggtttgaaggcgagttaagtgtggccgatgatcggttcattcccggcctaagtcgtctggcaactgcgatgaaaacaggcggctctaaagcggttttgcagatttttagtgctggtcgtatgagcaatagcaagattttgcgcgggcagcaacccgtcagtgccagtgcggttgccgcgcctcgttctggttatgaaacgccgcgagccctcacaactgaagaaattgaagcgaccatccacgatttcggtcaggcggtgcgtcgggcaatcgaagccggttttgacggcgtggaattgcacggcgctaacacctacctgattcagcaattctactccccgcattctaaccggcgaaccgacgaatggggcggcacgcgagaaaaacggatgcgtttccccttagccgtggtgcatgaagcggaaaaagtcattgccgaaactgccgaccgtcccttcctgttgggctaccgcatttcaccggaagagttagagcagcccgggatcactttagacgacacattagcgctcattgatgctttaaaagccaccaaaatcgactacctgcacgtctcccagtctgacgtatggcggacatcgttgcgtgatccggataatcctgccatcatcaatgacgttattcgcgatcatgtcgccggcgcctttccgatcattgtggttggcggtatcaagacccctgaagaagccgaaaaagccgcggcagcatttgatctggttgctatcggccatgaaatgattcgcgagccacattgggtgcaaaaaatacttgcccacgacgaaaaggcgatccgctatcagatcgcccctgaagaccttgacgagttgggaattgcgccaactttcctcgattttatcgaaagtatttccggcggtgctaaaggcgttccgttaactaccgcaaccaatgacgaacattaaacccttaagttattggccaccgttttaaaatttaagttcttcatgtgagtcgagccgtaacagctcggcttttttgtgattgtaatcttcctgcgtgatggctccggtatctaacagatctttgtatgcctttagcctggcaatagtcgcctgctccgctgcttgggcttgggtcgttttggctgcctgggctgcaatggcttgttggcgccgatagtagtacaaataagccgcaccgccaaggacaaggactgcgacaaagatataccaatattgtaccaacatggcaatgataaagatgatgatcaaaaacccgaagaatcccattttttgatttttcatgttgctcgctccaatcgtgactttcgctattgatcagtggtgtctggctttaaattccagtcattttagccgggtcaacccaagcatcaaactccgcctcagtcacgtaaccggtttgaattgccgcatccttgagatccgttcccgtgcgttcagctagctgagcgatggccgcacttttttcatagccgatatgcggcgtaagggcagtcaccgtcattaaggaatgcgcaacgagtgcctgcatgcgcggggcattgacggtcaaatctgctacaagtttttgcgtgaagctggtgatcgtctgtgtcagtaacgtcgtcgattcaagaaacgtactgatgatcactggtttatagacattcagctcaaagttaccttgggaggcggcaaccgtgatcgtggtatcattacccatcactcgcaccgcagccatggtaagtgcctctgcttgcgttgggttcaccttcccaggcatgatcgagcttcccggttcattggctggaatccgcaattcaccgtaacctgctcgtggaccacttgccagaaaccgaatatcattggcaattttcaacagatcggcggctaatgtcttaatacccccgtgaacattgctgatttcagaatgggctgccaatgccgcaaatttatttgtttgggcggtcagtggcaagtgatagacatcactcaaacgcccggccacaatccgcccaaagtttggcgctgcgtttaatccggtaccaaccgccgtaccgccaatggccaaacgaaaaagtgccggtttcaactgttcaatcgccgttcgatcgtgcgctaacatcgcaatccaaccgctgacttcctggccaaaagttaacggtgtggcatcctgcaaatgtgtccgcccaattttaacggtatggtcatattgcttggctttcgtttggaatgccgcgatcaagccatcaacagcagccatcaagtgattgacagcaatcgcagccgtaatgttcatcgccgtcggaaacgtatcgtttgaactttgactatggttaacatcgtcattaggtaaaatgggtaagtcaggattgagcttggctgcctgatgactgacaacctcattcacattcatgtttgtttgggtgccggatcctgtttggtaaacatgcagcggaaaatcagcttgtaatttttcatcaggcaaagccaataacgtgtctacagcctgcgtgatcagttggcctttgggagcaggcaaaacgtcagctgccacattcgcccgcgctgccgcttttttgatttgcagcagcgctttgatgagcggcaacggcataagcggtccggcttgaaaattatgacggctgcgttcagtctgcggtccccataaagccgtttccggaatttcaaccggtcccaaagtgtctgattcaatccgtgtattcgtcgtcatcgctacctccatcttaatcacatgtgctgcgattgcttgttaatgatagtcctattttacacgatcacactgccaagcaacccaaaagcataaaaaaacagccttagcacctaatgatcgctaaggccgataccccaacaccacaccttgtcgatgcagtcttgagatcaaagttcagtgaagcactgccgcaaccagccgtgccgcgtctttttgaaattgaagcgatgaagatgataaagccgctaaatattggtgaatcggatcggcttgcggggtgggtaggccagcgtgcagccaaccgctaatcaatgccggatcaattgaccaagcctgaacgttaaccagtcgctgacgggtgtctggtaccgttgttttcatccttgcttcggcttcagtcaaccggtgataagttgctggcgaaacagcatacatcaagggttgttcactaccaaaagtatcagtttgcagcataactgccccttccgtattcaatgggaaatttttacgagcaagactgctgcgctttaatagctcgctaaaggatttaacatcgtaggttcgactcacttgaaccggcgaggccatcatcccgttgaattgtttaaaaatctgccatggcgtctgcgttaattgataggacttatcccctggttgcgcacaatccaaggcgccgttcagttcaagctcccgccgtgcttttttcaatttaccccgatgctctacccctgcaatttgtccatagcgctcaaaaaatggtcgaccaccacggaatattttccgcttcttggtgttactctcagaatccagccgatccgcatacatgagtccgatcagtaaatcagtcgcatgctgcgataatccggtcgctgtttcagttggtacagcttgagtcataacctcacttaaatgtgccatctcatccccactttcatcgctgatgaccgtcacgcgtttgctggagcagaagtctgcgtgtaaggaccttaagcgcaatggccaaagcccagccatcacgcttaaggccgcttatgttctggcttatgcccataacgcactccccggcgcagaagtctgcgtgtaaggaccttaagcgcaatggccaagtgcgggccatcacgcttaaggccacttatgttctggcttatgcccataacgcgctccccggcgcagggatctgcgtgtaaggacctcaggcgcaatggccaaagaccggccattgcgcctgaggccacttacactccgatccctaaccgcgccggctcgcgcttacaaaaaagtcgccttgatcatgttgagctgatcaaagcggcttttttaacatatacaacaatggccaacaattatcttacttgttttggtgtaccttagattgctcattttccaatccaagaattgcgaataaccacggatcgtagccttctgactcctcgatcccatcgcaactcatcaccaaagacgcgacaagactattgtacgtcatcatttgctttcgcctcttcttcatcggctacagcttcaagatgagcttcataacgcttattacctttatacagatcccaaattgtccatgccaagagggccaaaacagctgcaatcagaacgtaagcgatcatattagcaatgttggtttgtgcggccgttggattatcaccgaagaatccggcgattgaatctggcagacctttcaggttcagataagttaaaccgataacggaaacccaaccgagcactttaacccagccagtgttcttgaaccgatcgcccatttcaaccttactattcgtaaacattagcagcggtaacattgagaatggcaacgcgaaggccaagaagacctgtgagttgttcattaatgtattgagcgcctcatgttgctgaatcggcgtttcccgagcagtcaacataacgcagacgataaccgggataacggagataacacgagtaaccaagcgccgagcccacagtggcatcttcatatgaatgaagccttccatgataacctgccctgttaacgtaccggtaatggttgagttttgacctgatgccaacaacgcaaccgcaaacaggatagataaaataccggacttggcaaccgcaatcaaaacaccgttactcagtgtggaagaatcagacaatgcctggaacaaaccgaagaaggaaggatctttaacagcaccgctcttgaagaccgcaacccccataacaagcagcaagcagttaacaacaaaggcaaaagtcaactgaatgttggagtcccatgctgaaaacttaacggcttgagcaacatcttccggatctttatgatcaattttacgagtttgagaaatcgcactatgcagatacaggttatgtggcataaccgtcgccccgatgattcccaaagccccttgaattggactcataccgttgactgacggtgaacttgcaaatgtttcgccagttggaatgaagcctttaagcaaagcccccatattaggatccgacaaagcaacttgataaacgaagaccagtaaaatgacaagaataagagcaacaacaatagcttcgatttttcggaacccaatcttggtcaacaacagtaataccagaacatcgaggaccgtgaccagtaccgcaataacaagtggaatatggaacagaagataaagcgcaatagcggcaccgataacttcggcaatatcagtcgccataatcgctaactcagtcaaaatccacaagacaatcccaagcttcttcgacgttcttgcacgaatcgcttgggcaagatccatttgactcacaatgccaagtttagctgccatgtactgcaacagcatcgcaatcaaacttgacattagaataacggaaatcagtaagtactggaagttttgaccaccggtgatggacgtggaccaattccctggatccatgtaaccaacggcaaccaatgctcctggtccggaataagcaaatagcgttcgccaaaagcctttcccgtgtggcacctcaactgtaccgttaatttcttccaatgacggcccgttcgcgtattgaatgagcttcatggaatgtttcttcttgtgatcatcactcacaatatgtctcccctttcatcttgaaaaaagttaagtccctggggaacaaggtcttttaggtctccctaacttaatcctttcttaggatatgccttgaagctgatatcgtcaactattttatgaaaattaattgtattttcagtgactaatttgtaaagtgtccattgtttcaaaatgcctaagcagtgcccgattcacggcaatagctaatcacgcttacagccgattgctttcagaaaaccgtttcaaagcattaggtcatcataatcccgatataaaagataaacgcttttttagctcgcattaaattgaaatcgcaaattgattgcaaccggtttaggcataccatatgataaaggtagtaccaaaaaatttatatcacgaaatgaggaatcacttatggaagaagttcccgactcgcaaccgccagcaacagcgcacagtatcaaggatctgcagcaaatgttgcaggtcccgtcccttgaccacggtctctctaaaacagaggccgctaaacgcttagaagccaatggcccgaatgccatcgaatcgcatccaacgccaaagtggctgatctttctgcggcagttcaacaatttaatcatttatatcctgatcattgccgcaatcctaaccactgtcattggcgatgtcactgatacctcggttattgttttggtgattatcgtcaatgcgattattggatactatcaggaaagtaatgccagcgattcacttgaaaaaatcaaaaaaatgctggcccctgaagcaactgtttatcgtgacggcgaacgtcttgatattcccagtgccgatttggttgtcggcgatgttgtttttctggaggccggcgataatgttcccgccgatttacgcctcgttgatattgacaacttaacgattcaagaagctgtcctgaccagggaagcaaattcggtcatcaaaacgactgatatcctgccagcagacacaccacttgccgatcaaagcaatatggcgtttgcctcgacagcggttgcaggcggtagtggtattggcatcgtggttgcaacgggccacgatactgagttcggtaagatttcccaggcggtttcggacgtacgtaaaggccgctcgccgatgatgcgcgaaattgacggtatcggtaaaggaatttcgtacgccattatcgcagcagcggtcttactatttatcttcggcctgatcatcggtaaatacagtctgcctgtcttagcccttgccatcgtcaccatggtcgttggttcaatgccagaaggtctgcccgccaccacatccgttatcctggcaatgggtgtttccaatatggcaaaaaagcaacacgtcattgtcaaaaccttgcctgctgcggaaactttaggctcagtcgatgttatctgtaccgacaaaaccggtacgctaaccaaaaacgagatgaccattaccaccgtcatcacgccacaggccacttatcaggtaagcggctcaggctacacccctaaagggcagttcaccattgccaaaaaagctatcgagccagcaaaccatccggatttaactgcattgctaaccgctggatttgaagccaatgacactgaattgcaccaagaagacggccgctatgtcatcaacggtgaacctactgatggtgctttcctcactgcctactacaaagccttcaaggaagaacccgctaacaccgaacgtgacttgatgccgtttgattccaacaatcgttacatggccaaattagcaaaatgcgcggatggccacacccgtctgtttgtaaaaggttctccggataagttgttaccgcttgttgcggcggctcatcccgactttgatcaatcccactatttaaagttaaccagccaattcagtacggaagggcaacgcgttattgccgttgctcagaaaatcgttccagatgatactagcgaaatcacgccagcattattgaagcaaggactcgattttctaggactgaccgcgattattgatccgccacgcgagtcagtgatttcggcgatcaagcaaatgcggcgcgccggtgtcaaagtcaaaatgatcaccggcgatcaccccgagaccgcgctagccatcgccaaaaaactaggcatggccgattcgcctacagccgtcaccggcacgcaactagcagcactgccggaagaaaagcaacgccagatgatcctcaatgccgatgtctttgcccggaccacgccaaaggacaaactcacgattgtctctgtcttacaggatgccggaaacgtcaccgccatggtcggcgatggggtcaatgacgcgcctgcacttaaaaaatctgacgtcggggttgccatgggtcaatccgggaccgatgttgccaaagatgcggccgacatggtgctcaccgatgaccgctttgcccgcatggaaaccgccatcgctcaaggacgccgcatttaccaaaacatcaagaaaagcattttgttcctattaccgacctcttttgccgaaggactggtgatcgttttcaccattctgactcaacaagcgatgccattacgtgccagtcagctgttgtggattaacatggtcagtgccatcaccattcaatttgccttcatcttcgaacctgccgaagctggcacgatggagcggccaccacgtaagaaaaatgcgtcaatgatgcacaaacatgatgtctttcaaattgcttatgtggccatgatgatcgccggtatcgggttgtgggcgttcgactggttgacagccaaccacttaaccgaccgcgtcaccgcaagcaccatgatggtgaacatgattgtcttaggaaaaatcttctatctctttaacatccgcacaaacacactggctctttcaaaaaatctctttagcaatcccatggcgtttgcgattatcggcatcatgttaggattgcaatgcttcctgacttatgttccttttatgcaggaaatcttccaaactgcttcgatgtcgtggcgtgaatggggcattgctgttctagccggttctgtgattttgatcgtgactgaaatcgacaaaatcatccgcctgcgctggcaacggcttcacggccacgatgcgtttcaatccaccacaaaaatcagtaaataatgtttggacagcctaaactttttcttttcttttggcattaacaatggtaagactataagtaaggtttccctaacaaaccttatgcgtatacaaaaagtccgataaactggttcatcatccaccagtttatcgggctttttgggctttcgaaggcgatctctgaattaatgttccgtgatgctgtgccgattctttcgccttaaaatatttcaggcaatcctaaaatttctcttttaaataagccgacaactggtatactggaagtgaaaagaagaggagctgatcgttttgaaattgtatcaaggtctcacacaagtccaaattaatgaagaatttgccggcgaagcaaatggctataagattaccaccacccttgagaaaccgctgaactacgagccggcaatcttgtatcagtacttggatgccgtcttaaaaccgggcagtcgtcatgaccaaaataatttgcgttatgtcaccgaccccggattcatcggtgaaaattacgattatcaaagtgttcctttcacctcacatatgactgatttcgatgagaaaatggcttttgcacgcaaactggttgccgacctcaaccgtcatttgtcagtcaatgtcaaaccggctgattccgaaattgaactgattttcgttgactgagcaaccgcgttacctcctttcctagtcgcgatgctgctcctctcccgatcagttgcggctaagtcatccagtcaagcagcttagttgcagcaaaacgccgcctatccgaagaaaagataggcggcgttttggtgtcgctggaattactaaaacccctgccgttacactgttgacactatttatttttgggtaatgatgaataatctgatcaaacggtggccttcaatgcttttctggtcttctatgagaatcacttgcaaaatacataaaaagcgagccattgttgtgacgttttcacccaatgacccgttcttttaatgcttttgttcaaccgcttttggcaatgtcaaggccagcaatagcccaactaagcccacgccggcaaagacagcaaaggtaactgcaaagccgccagcgtggctatttaacgtcacctgcatgttgtccaacaatactgtcgcaaacatcacgccggctgagccaaataactgtcgggccgttgtggtaaccgcggttccatcggccaccagttcatttggcaaggcattcgcgccagccgtcacagaaggcatcatcacaaaggcattccctgcttctgttgccatcgctaacacaatcgcacctagcaacggcagatgacgagcaaaaatcgccagtaaaccaaaaccgcctgtaatcagaaccatcccgatcatcgcgaccagccgcggaccaaagcgatcaagcaagcgtccactaaccggattaagtaaactcagtaagacggctgctggcacaagtgacaggccggaaactaacggcgaaagacctagcagggtttgaaaatacaacggcatcagaatcgtcgtaacaatcaaaccgatgtaagaaatgccggttaagaagaccgctttggtgaacataccggttgcaaaaacccgcatttgcagcatcggtggttggcgattcaattgccgaatcacgaagataccgcctgccaaaaccccaacgatcaacaaactaatcaccccgacgcgcaggccttgttttgaccacgcacttaaagcatatagcaagatcggaaagctcgccgacaagataaacgaaacccagtctaaccgggtctgttccagcggcatcaccgaggtaatcgtgacagtcgaaactgccagtacaagcactgaaacaattaggaagaataggaataacgcttgccatggaaaccacgtcaacaagacccctgaaataatcgggcccaccgccagcgccgatcccattaccaagccggctgttcccatcactttaccgcgttcactgtgcggcgtaatcgtcagcagcactgtctggaaactagggaaaataatcccgacggcaaccgcctcaagtaaccgaccaatcatcaaaaccgcaaagcttggcgcccagatacataaagccgtcccaactgcaaaaatcagctcaattgcctgaaaaagccgctgaaacgggacattatgcaacagccacggactcaccggaatcatcagcgtcatgaccagcataaatcccgtcgtcagccacgcgaccgtatccgcgcccaaaccaaatgccttcataaaagccggataggccgtactcaaagaagattgcgaaattgacatcgaaaacgttcctgtcagcaaagttgcgacaaaagcgccgcgatgtttaatcgttgtaccattcataacatcatcgatttctatttgatttttggtgcctcacattttcatacccattttttcatacgactgcataccgcccatccataattcagatggtttgaccccacgttccttcgctaaggctgtcatcagtgtatccatgtccattagtttgtattcctgtttcggcttcgtcggatcaaacgtttcgatttgcgccatcatgccaccatcttcatgttcaataatgtgacagtgatacatgtaaactcccggtaaatcaaagcgcactaacagccgaactgtttcacctggattaacgccaactgtatctttaaatccatgctcatttggataaggcgcatgcccgttacgggacaaaatcaaaaattgcgtgccgtgcacatgaaacggatgaaccatcccgggcgcagcattactgttggtaacatcccaatactgagctttgccaatcggttgagtcgcatcaattcgctgcatggcaaactttttaccgtcaatcgcgacactttcatccattccttgcatcaccacatggcgaactggcaacgcaggatcaactgcaggtgccttcaccgtaaagagcttgtccggcaattgcgtgtgatccggcttgaaagcatgaatccgaaacttcagcaaaggcacattatcggtgtaaagcgtgaccacatcgccttcatgacactgaccaaaatcgacaatgacttctgcccgttcagcacacgtcagcatcaaatgcgtcaaggccaccggttccggcaacaacgaaccatcaccgccgatttgggtaaacggcaaatcatcggaaaaatgcagccgccactccctgcgattagcgccatctaaaaaccgtaaccgaactttctgggtagtcacatcgaaataaggattaatggtgccattaatcatcgcggtcggaccagcaacaccatccggatcataatcagtccgataattccactgattctgctcatggaaccggcgatcctgcaaaatcaccggaatgtcgtcaaccccgtaattgtgtggtaatggcaagctttcttcatgctgatccttaacaatgaccattgctgccaaaccgtgccagacctgctcggcagttgaaggacacgggtgggcatgcagccacaatgttgccgccggttgatccaaggtgaaatcaatttgcttactttcgcccggataaaccggcgcatggcacccaccatccacataagggccacttacattagcaccatgccagtggaaagttgtcagttcaggcaaggtgtttttcagtgtcacatgaacatgctggccgcggcgatagacaatcgtttgcccaagcaagctagcattataaccccatgtttttgtctttgcaccgggaagcaactgtgtctcccccgcttgtgccgtgacggtgtaatacacatcggttgccgtttctttatcaggttttagcaacggcggcacatttaagggtttggctggcgcatcgcttacttcaagtggcacataaccgccatcatgcaagtcaaacgccggctcatcaaagaaatagtcggtataggttttcatcatcgttcccccctcgcttcaaattctagcactttttagggttgccataaacgtaatttggaattaatctaaagtaggtgcttcgtaaaaagaagggaggaagatgaaaatgatgtcaaaatccatgggctggttgatgttggcacttaatgttgtgttgctggtattaattgccaccatgcataacatggctgccatgtggctgatgggcattatcatgtcacttgatgcaatctcgggattggtaaatgcgtatcaagccgaccatgaaacgcatcaccatgccacgcagcattgatctttaagcagacttgatgctgattgtccgtctacctcacctttcttttatgttgacattaacatatgtttggaataccatatgttagcaaataaacaaagagtgaggcagcaagatgaaaccatttgtcatcgccaaaaacgctgatatgacaaccgccattcgagttgaatatttttctactggctggatggcgtttgaatttttgatcggcttctggtcaggatttcaagcagggtcgattctgttaattgcgtttgggctggatagttttctggaaattatttccggtgccactttaatctggcggctgaaaacagaaagtaacggtgcaagtgcttcggcagtcgcccgtgcagaacaacgctcaagtcttgtggtcggctgcgtgctgttactgctgagcttatacgtcatcggggtttcaggtttcaatcttgtgacgcacgcagccgctgaaagtagtatgagcggtatcggtattgccatcgcgtctattattgtgatgccatttttgacacttagaaaacggcatcttggtcacaagcttaattctccagcacttatcgaagacggcatgtgcaatatcacctgtgcctacatggcggctactgttttgatcggtagcttgttaacttggctatttaattggtggtgggccgattcggttgcagcgttgattttagtttattttgttgccagtgaaggctggaaagcactgcaaaccggcttgagccacagcgaaaacgaagaataaatctttccggaaaaatgaccttagagcaaagcgccttgaatgaaaagacgtcttgctttaaggtcatttgtatcactttgattattattcgttcatcaatggaaaagaggaaaccgttaatgactgctacgacgctaaggttggttgaatcggccaagcttgccgaagctgagcgtattttcaaactgctcagtaatccgacccgattgcagatgctgaaattactcgaacaacaagtgctcaacgtcagcaagcttagtgaattattaggcgttgagcaatccgttgtctcccaccagttagcgctcttacgcaagcaccaactcgttagtgcaaaacgtgtcggcaaagctaattattatcaactcgacgacccccacattattgcggtcattgatgccatgctcgcccacgcagatcatgtcgcccgaggtaagcaacacggtcaatgactcattttcgagaaaaaaacaaggtatattcctttacacttcaatgtgtataaggatataccttgtttcttttcatactgatccttaaaactagcctgccaatccatcgtgaatcttatcaaggttccacttcatcatcgtataatacgtatcgccttgagtccccttagctgccagcgagtccgtgaaaatcttcgagtaaatcgacaacccggtctctttggccactttattcatggacttcggtgagaccgaggtttccacgaatagatgtttcacttcggatgcacgaatcttagctaaaaccgtctgcatctgttctggtgttccttgagattcagtgttgatttcccaaatgtatgccggggtcacatgataagccttggaaaagtacttaaaggccccttctgacgtcactaacacgcgttgcttttccggaatatcgaggaagcgtgactgcgcggtttcatgcagtttttgcaacttggcaacgtatcgatcgctattcttctgataataagcagcgtttttggcatctttttgtttgagcaccttggtaatcgtcttaacatactggatgccattagctaagtccagccaagcgtgcggatcctgttctttggtgttggtcgtcaagtgttgcgcggtcacacctttacttgcggcaaaaacatccttatcaaattccttgtgcgacgtcttaaccaacttcttaaaccagccattaccaccggtttcaaggttcaaaccattatgaaacacaacatcggcttcactggttgccgccacatcggttgggcgcggttcatactcatgcggatccgtgccgcgtttaacaatactgtacagcttgatccgctcgccgccgacattttgaaccatatcctccaaaatcgaattggttgtgaccacccgcaacgtttgattcgtgcttgctgaatctttttgagccgtactccgactgttaatgaaccaaaagacaccaccgaccatcacaattaaagcacctacagtaattaaaatcttcttcatcgaataacttcctccgcggtttgagtcgtcgcggctgttttggtccgctgacgcttactgaaactaaagaatgcctgttttggtgaaaagacgaacgagatggcgaacaataccgccgctacgagcacaattgccggaccggatgcccagttaaaggtgaagctgaaatacaacccggtgatagacgaaatgaccccgacgcttgctgccatcacgagcatggtttcaagccgatccgtccataagaaagcagtggcagcaggcgtgatcagcatagcaacgaccaaaatgatccccaccgtctgcaaggccgaaacagttaccaaggttaaaaccagcatcaacgcgtaatgaatcgcagtggtattcaacccataagttttagcaaaggtattatcaaacgatgtgatcaacaattccttatagaacaacaccacgaacaagatgacaatccctaacacaaccgcggtggtcataatatcactatcgctgaccgccaaaatattaccaaacagaatatgatgcaagttcgtagcgctttctgccatcgaaatcaaaatgaatccgagcgcataaaacgcactgaacaccacgccgattgaggtatcggttttgatcttactatttgccgcaacaaaaccgatcaacagcgccgcgataatgccaaacaccgaagccccaatcatgacgttgacacccagcatataagcaacggcaacgcccggaagcaccgcatgggaaattgcatcccccatcaacgacatgccgcgcaaaataatgaagctaccaatcaaaccggacatgatccctaccatgatggcagtaattaacgcactttggaggaaatcatattttcctaacgcggtgaaaaattcagctaatgaactcatacgctcgccccttccttggttgcaaacagcacgttggaaagatcggccgaaaatgcccgttcgatattttgagccgtatacacttcttcgaccggtccttcagcaataatgccgtggttcatcaccacaagttcatcaaaataatttgaaactttatttaaatcgtgatgaacgacaatcagtgtttttccggcatcgcgccactgattcaaaatggccatgatttcctgctcgctcttcatgtcaataccgacaaatggctcgtccaggatcatgatgtcagcctgctgcacaatggcacgcgccacaaacacgcgctgtagctggccgcctgatagctgactgatctggcgtttggtgaaatcctccaacccgacttgttccagcgcttcaagtgccgcctgacgctcttttttaccggggctcttcaacaaccccagacgtccataggtgccagtcagcacaagatctaacacgttaattggaaaagtcagatccaaatccttgcgctgctcgacataagcaatcgcctgttgcacttccttgagggtgcggccggaaaagtcgaccttccctgattgaaccttgatcaaacctagaatagctttgatcaaggtcgatttacctgctccgttaggcccaatgattccggtgatcttacctgcgttaaaatgaacggcaacatcagcaaacaccggtgtgtcagcgtaggcaacggtcaggttcttgactgttaacataagaacctccaattttagggtgacctaattcgctttcaccctaagcttacagaaaagaaggaagactggcaagtgttttttaaggcatacttaaaatttttatacgcggtacatcttggccaccaacgctttatcgtgtccgtctcaagtcatacttataaaccccgataaatcaaaaaatgtaatcgcatgcagttattggaacttatttgagactataaaaagacctatgagtaatttcattaattactcataggcctttgtttatcttcccgttatttaagtcacaaatcagtcgcaactttttaaaaggccggttgttattttttctgcgtacgtattaccaactggctttacgaacaccgggaatctggcctttgtgtgccaactcgcgaaaattaagtcgcgagatgccaaatttacgcatatacgcgtgcggacgaccatctaaagcgtcgcgatgatgtaatcgtactgggctggagtcacgtggcaatttgctgagtccgatataatcgccttttgctttcagttctgcgcgttttgctgcatattgttgaactaacttctcttgccgttttgccttggcaatttttgactttttggccataagcttcctctttctataaaatgtgacgagccatctcattaaccgacctattttccgacaccgacaataggcgtatacgaacgcttatctggatttttgctgcttgcgcttcgcatcgtgtagaatttttaatgctcgtttgcgcgttttaatgttgggactcttcatccggcgccgcgcacttgctaaatccgttttttccaaaatttccctctccctttaaatcgtaatcattacgcttaatgacgaatttaaccgtatcatgcagctgttttgactgtcaataactttttcaggacgaacgcttctttgacccaattcaaaaaaagacttgtcaagccggtttttttgctttagagtttaaatcgtaatgattacgttttggaaggaagcgggtatttatgatgaaacgattacttgcaggtatcagtgtcgcactcttagcagtttttgcagtcgcgtgtggcaataatggtgccgcaaagcaatccagcgctagcaacgataaaattcaggtagtggctagcgtcgatttttatggtgaggttgccaaagcagttggcggtgataaggtcgcagttcagtcggtgattaacaatccagctgttgatccgcatgattatgagccaaccaccaaagtcggcaaagcagttgcaacatccgatttcgtcattgccagtggtatcggctatgacggctggatggacaaagtcgttaaatcggaaaacaaatcgaaaaactacttaagagttgccgatgatctgatgaacaaaaaggaaggcgacaacgaacatatctggtatgatccgcggacaatgccaaaactggcaaatgcgctggcggataaatttgccaaaaaagacccggccaataaagccaagttcaaagccaacgcaaagaaatacatcgcttcattagatgacctcaatgcacttgttaataaactcaaatcaaacgcaaacggtcaacttgttgacgtctcggaaccagtcttcggttatgccttagattacctaggctacaagatcaacgacgcccacttttctaactcaaccgaagaaggtaccgattacagcgccaaggatattcatggtattgaaaccgacatcaaggaaaagaaaatcgcctttttcgttaacaacattcaagcgacatctaaaaccgtttcacgccttgttaaacttgccaagcaaaataacgtgccagttttgaatgtcaccgaaacacttcctaaaggcaaaaactatcgcacatggatgatgagccaataccaacaactcgaaaagatccaaaatcaagcaacaacaagcagtaagtaatcaaactcgtctgaccacaagggtttgttacacttccctttacctcggtatcactcaccctgtaccgaaaaaatccatcaatggtttagcattgatgccccaacaaaccataagttcgagtcaaaagcatcgaacagtctggtcaggaaaagtccgcaaattgcggactttttttagtgagcgcgacccggcgcggttagagaccggagtgtaagtggccccaggcgttttaaatcggaagtgttacactagagtcggcacaagaaaggaagatgagtatggcaaatgtgatgattctaggagcacacggccaaattgcgaccttggtgcgccaccgcttgctaaaagaaactcagcatcatctcaacttgtttttacgccatgccaagcgcatcactgatgttgaccgccaacgagaaacggtttacgacggtgatgtcactgatacggacaaactgacaaaagcaatgagcggtagtgatcttgtttacgccaacttagggaactcagggattgaggatcaagccaagtcggtcgtcaaagcgatggatgccaatcacatcaaacgcttaatttggatttcaacacttggtatttacgatgaagtgccaggtgcatttggtcgctggaaccataagatgttagacggcggttaccttgaaacctatgctgcagcggctaaagtcatcgaaaattccgacttagcctacaccattattcgccctgcttggctatccaataaagccattgtaagttatgaactcacgcaaaaaggggaacccttcaaaggcacagaagtctcccgaagtagtattgctgatctggttgttaacttaatcaatcatccgcatcaacacatcggtgaatcgcttggcgttgaccagccgcatacgcaaggcgataaaccttccttctattaatcttagcgtgaagtttttccaccacaaaaaaatttcatcttcattagcgtgaccgctctacaaaaagcatcaccggcacatgaggatgaaatttttttactagtcaaaccgttttggcagttcgacgctatttactactttcagttgtgacagcttgttgattgttggcaaaattgcgaattgattggggaatttgatcgccaaaatacttttcaccgacactcacggcctgtttgaagaagccttgaccgttagcctgataagttttcgcatcattatttattgcgctggttaagagctcgctgccaagcttattgtaattagtcaaggctttggttaaaccgtcctctgttttattgtttgctaattcgaggcgaatatcatccaattgcccaagcccttttttggctgtcttgctaatttccttactatcactttgcaacgatacttttgtcatcgttttcatgacaatatcagaaatgcgcgtgtaccgcttttgcaggtcgtttttggtatagtgatttgttttaatcatcgttgaccccgcatcctgtgacgatttagacgccttggactgacaaccggtggccccgaccattgtcaaacagattacagtgatcaatagccattttcgcaacacaattccccctcgatcaaactgttcacaaccattcttcattaagttcattcaaccacaggcgtgatacagcgtcaaacaagtcaccgcaaatgacaaatatgattgcagatgcttttggataaaaagttcaccatgacttcatgaccatcaaaaatagtcccagaactaccggcatcatgttttcaatatttttcaatcttatacaaatggatatattatgccagattagcgtttcctacgattagtcatcaatatggcatcttttagcttgcgtcaatatcgccagtacgctacgcttaaacgcgtcatcattacggttaaacgaggagattcagttatgttaaaacggttattaacagtcatcagtctgctactactaacaacagttgctaccgcatgcagtacgaataccaaatcatcaggaaaacatgaaaagatccaagtcgtcgcaaccgttgatttttatggcgaagttgccaaagcggttggcggcaagcaagtacaagtcacgtccattatcgacaatcctgccattgatccgcatgactatgaaccaaccacccaagtcggcaaacaagtggccacagctgatttaatcatcgctaatggcatcggttatgatggctggatggataagctaatcaagtcggaaaacaaatccaaacagtatttacgcgttgctgatgatctgatggctaaacatgaaggcgataatgaacacatctggtatgatccacgcaccatgcctaaacttgccaatgcgttagccagcaaatttgccaaagaaaagccggcaaaaaaggcgatttttaaagccaatgccaagaaatacatcgcctcgcttaactccctcaatgccttaattaccaagctcaagcaaaatgttcatggtcaaaaagtcgatgtgtccgaacccgtctttggctatgccctcaattatctgggctacaaaatcaacaaccgtcattttgcccaggcaactgaagaaggtactgattacagcgccaaagatatccatgcgattgaaaccgacatcaaagaaaagaaaatcgccttcttcgtcaacaatagccaagccagttcaaaaaccatcgatagtttcattaagctagccaaggaaaacaaggtacctgttctgaacgtcaccgagacactgcctaaaggaaaaaactaccgcacttggatgactgatcaatatcgacaactggaaaaaatccaaaatcagacggacactaagtaaccttcttgcccgcaaaacctacgagcagcatacgtttaaaacatgatagtttgtgaagccatgtgacatatgaaacattttcgtaaactttttgaaatgaattcgttttcacaccccttataccaattgaatttttgaccggttgaactacaatagacttgtaaacaggagcaaccaaaggggagatgttttaaatgtcattgttcaaacatacttttaaacgcgttgagcacttgatcgccgcaccacgcgatccccacgaagaagaacaagcacgtttgcaggagaacttgttctatacaaacctcagtagcctccaaccaaaaacaaatgccagattttgattgatggttactataccaaaagccgtctcatctgcaggtgaggcggctttttatgtgtccagaaagcaactgtcttccctaagataatccgatcatcatactgcaaagtacctagcaatttttctgacctttcttcttcactataaatttgggcgagccttccatcattcttgacgttacttttccaaaaaatagccagctcgctaataaaaatgcaaactgactacttaaggccatcgataaacttagttctgtgaccttttttatattttaaatggcgactagacgctgagcaaccactcccacagcgattgaaccctctgtttaggtgttctttcatcgccagtctgcctcacatttggatgataggaataacgagacccccacgatccgttgattcctggtttccttacgactgacctatatgaaagaatccagcacttttttgaagaccataaaactgaaataatatcgtctttcggtctgttcatgctgcgccgatttctccgatgtgtctacccttatctctaactaccaaaaccttgcaatagcactctcacaagcgagagtataaaagccattttttcatcataattgtctcgcctgctaatcatcccacatgtttagcaggctaatatcaattactttgcatgacgcgctttacgaacgccagcgaacccaagaacagcgatgatagcggcaccggcttcggctaaaagaagacccgtttgcccttcacctgtagctggataagcgtgcttgccattcttctgggccatccgactcataggttgtggattggttgactgagtggttcctagtggtgccacggcagcacttgaagttgaggagccggaagtgcttgatgatgctgtggcacctgcacttgaggctgatgaacttgaggcactagaagatgctgaactgcctgtacttgaggccgatgagctggacgcgcttgaggaagcagaactgcctatacttgaggctgacgaactcgaagcgctggaagatgatgagctgcccgcacttgcagcagcttatgtagcagccgctgaacttgaacccgctttggccgtattctgcactgctgccgagctagctaccgtattatccagctcttcctgttgcggttgcccctgcactgactgaggagttgctacttttgatgcccgcgattcattttgctgactttgcagggctacaggtgccttttgacttgcatttccatttttagaaagcgttacattggcaacgcctaaagttgtcctgccaaaaagtacgacaaacgctgaagcaacaacccattgactaccgcgcttgtacattttcttcttgtcattgacgacatgttctttgaagcggttatataaacatatttactcctccaatagcatcaatattgtatctgctaaagctcggtacaaaacttattatatttttgaattaggagtattatgcctatgcaatacggcgcttcttgagatgactcgtcaagcaaagtattttacaacctttttgatagtttcatataagtaatgaaacccttaaccccgctaccatcgccaacacccccagcagcacaatccccaaataatacccaacaaacacgcgccactgccgattacgaatcaaaataaatgcgtctgccataaacgttgaaaaagttgtaaagccaccgcaaaaaccggtcagcaacaacacccgaaaagcagaaaacgcgggcaagccagctaaaaatcccgccaaaaatgccccaagcacattaatcatcattgtggcaaccggttttccgggccacaacatccgccctaacaccgtcagtaaataccgacaaacagctcccacaccagcaccaattccgaccaaaattaccatgagcttttatcctttcgtggtagcctttttgcaacaaagaatccgcctgccgctgccatcagtccgccgataagattcaagcttagcaacagaaacgcatagaccgcatgcgttgccaccaaattaacaaagtccagcataagcgttgaaaaggtcgtaaacccaccgatcacccctgttccaatgcctaacaacagccactctggcaagtcaaatctcatgtctagcccataagtcgtaaacgccagcagaaaactgcccaataagttcacaattgtcgtacccactatggtttgaccgtccatcgtgactgaactaaggccatatcgcatgaccccgccgataaaaccaccgacaaatactgccagcacccaactaaaccttacttgttcccgttgttgcatagattgctcctttcttcatccgcgcgttgccgtacatgtgtccaaaaaaagacacctaccccgttaattacaaggtaggtgtcatcaacttacgtataggcgaacaccatcgccatttaattcattgaaattatatcaaataattgcatgggaaaacagcgtcgggaagtgattgatttttcattgtagacaaacatgacgcagcttaacttatacccagctgaccgaccgccaacccaaaatacttgccacagtaaaaagcccgcgctgcaacaaacagcccggactttttaatttcagtcgaagtcagtgaacgcgcactgactttcggctttaaaatggtacccgcttatcacgggaaagtcattcagtcgaaactaagaaaacatgggagtgttgtcactatcgacatgacttaaaaacgctattttggagaaatgacgtcagcagcattatttgatgttgtcaccatggttagtctaccaagtcgagcgatcgcttggtcacacaatattattgtgcccccagagttggtcgtaaccaaagccagtcagatcttcaacttttgctttgacggcgggatcaacatccgccatcttgccgcctgccttcaagcgatcgatttcatcacgaaggatcttgtgattttcacgatccaacttaaagaagtaggaagtaacaaacgcgagtaacagcattaacgttgtaccaactaacatccagatgattaaaccgtttatcgcagcggcactttgcgtcttggcgccttcattgaatccaaatgctgataaaacaatcccggttaaaaatggtgccagcgcggaagttgtcttccgagcaaaggtcataataccggcaaagataccttcgcgccgttgtttggtgaccatttcgtccacatcaggaatgaacgtgtaaacagtccatggcacatagccggtaccggagtttgaaatgccccaagttacctgaagtgcatataaggtcatgatgccccagctagtcgcagctgcttggccatagtacaaaccggcgtagcaagcaaccgtgaagaacatcattgcatacataatccgcaataacttggaaggtccaagtttgctcatgatctttggccataccaagttacatgggatcccgataatggaaccaaacgtcaaaatattggaagcttcagtcggattgctctgcatggcatagacaatgtaaaacacataggttgccccgacaatatcacgtgctgtaaatgaactcagataaataactaagtgaagtgcaaaggatttaatccggaagaccgaacccatatccttaatcatgttccaaagcgatactaaaggattttcgcctttatgactgctttcttcaataatagctttacgttcttccggcgttccatccgtctcacgttcaaaggttgagaagtacgtcaagccaatggcaagaatgaagatgatagcaagaatgatcccgatggttaagaatgcgtttggattatttttacccataatggcaaagacgcgacctggcagccatgaagcaaggaaggttgctaaagctgaccaaagcatccgcgaactggataaacgtgacttcatatcataatcatctgtcatttcagcggccagcgtctcgtatggaatcataaccaacgctgtgaacgcttccatgagcaggtatgtgaaaagataaaaccagaagcccatatgtgaaatccagataatgacatagataaacatcagcggaatggaaattagcaggaagaatcttctgcggccaaacttccgtcctaatttagttgcaccgaagtgatccgttaagtaacccatcaaagggctaataaaggaatcagccacacgtgcaatcgcaaggatcgtacctccaagcactggagataacccgccaaaggatgtgtagaaaaacaacatccatgtggaggcaacggttagggccccattaccaaataaatctgcggcaccgtaaccaataacattacgccacctgacttttctcttcacgatgaaaacctcccattcaattagcaacaaatagtgattcggttcttttcgtaaacgtttacaaaaatgaggttaacaccactttcgtaaaatcgctatctaaatttgactattttagtaaaaccagcgcgattgctaatgatatgtcccaaaataaggacatatctacaggatcagaattagttttggcctttgaacgctcttcatgttctcgtcgcttatcaataccattatgcaaatcggaatcacctatttgtgcttttgatcgttgcatatgctgttgtagatttttgtgaaatttacagcaaatgaaaaataatatctagaccagtttcgcaaacagtgacgcttttcctttgtatattcaaaatttcgtgatgtccatctgatcgatccagtggtacttttaacgcatctttagtatcaaaatgatttttagggacatcaatctagcaagtttgggacaaatctccatctatgaaaaggcaagattttaagcaataactgatatcacgcatttcataacttcatatcaaaagcgacttttagtaaacgcttaaatgccatattgcattttcaatttttaaaaagtacgctaaaaaaaagaacgttttacttaaaaaggagctaattaggcatgccaaatataacaccatcgttactcgcgccggatcatctgcgcgttaacttgcaacattttgcttataacgtccaaacgcaaccgcatttcagctggtggaaccacagcaatcgcaccggagcatcgcaaagcgcgtatcagcttacggtctttcagcgccttcaggatcgtcaggatcataaatatttgtacgatagtggttgggtaacgagttcgaataataccgcggtgacggctgcaaagttatccgatcaactcgttgctggtcaattgtattattggcaagttcgcatcaaagacaacgccggaaatatcagtgacttctcccagcctgccaaactgatctgtgccgatccgtcgctaccggttaagcatggcatctggcgccaacctcaacccaaaacggcccaagagttggcacacatcggtcaggttgtctttttgcgcagccctcaactcaagatcaatccgagcgaggttgatactgccatcattgttgcggtggcccggggtaatgaaccggtttttgctcaaagtttcgatctttatctcaatggtcattgtctgggggttggctcggctcgccaacaggaacacgatcatggaacagaaaaaacggctatttactataacgtttatgaagctaccgattttttgcaagacggggcgaataccgttgcagccttggccactgcaagttcagataagcaggcattctggtgtcagctgatcctgtataaacatgacggaacgaaagaagttgccacgaccactgacaacacctggcgcgcattagatggcagcagtgcctttggcgattatggcgttaagatcagaactcaatatttcggtatggtcagtgaaaatatcgacatgcgttactatcctcagaactggaccagcagcgcatttgatgatcatgactggccgcttgcatggcagaatcctcaccaaatgattgccgacaatgaagtactggtgccatatcgaagcgaaaataccgagcgagtggaagtgcatgatcgcaataaacgggtggtcactttttccgatcaaaactatctgttggacttgggcaaagagatcattggcgggctaaaggtcaatctgttcagtgccttcgatcagcgtgtcaccgtgatgatgggtgaacaactaaatgacgacggccacgtccggcatgagatggcgtgcggacctgattacatcgaaaactgggcgcttgtaaaaggccagaatcaattcaccactttacaaatgaaaaacttccgctatgttgaactggtaggatttgaaggcgacttgccgcttgatgccattaatggttgggccatgcaacaagcatttccggataatgagagtcggtttgatagtgacagtgagttgttaaatcgtgagtacgagttgtcgaagtatacgatcaaggcgacgaatcaggatgtttttgtcgactcacaagcacgcgaacgccggccgtatgaaggcgatctccttgtgaatgccaatacgagttatagcgtctcctcaaactactcactggctcggcattctctggattatttaattgacaatccaacctggcccgaagattacaaactgttcgcaattgaaatggcttggcttgattatctctataccggtgatgatgatttactgcaaactcgttacactgacttacagtacaagctaaatcgcggtaagtccgcagaaagttttgacggcgcctcgcaaagtttcactggttcgctgaagaacagccaaggtgtcgacaattttgacgctgcagttggcttggtcaccaacgatgggctggtggactggccgatttccgaacgtgacggctttatggaaggtacttacaatacgccatttaacgcgattttccatggtgcttgcgcgacgatggccaaaattgcgcgcgtccttcatcatcccgatgacgctgaccgttaccagaaacgagcggaaatcattaagacgaatctgattgataaattatatgacccgcaaacaggccggttcttcgattcgttaaacgcggatctatctgttaatcgccatgcatcacatcacgcgtctgcttacgcgctttgctatggcgtttatactgatcaggatatggccgatcgattaagtcattttgtcgccaatgatggtcattttgtcggtagtatctactttatctacttcatgctcaaaggactctttgaagccggtcacgcagccgacgccatcacgctgttgaccgaccctgacaaccacaaggatcataagtcatttgcggcgattttagacagcttaaaagcaaccattgccccggaagcttggagtaatgcgtacaagccaaatctcaccttatcccatccgtggggcgccactcccggcttaacgattgttcaaggggtctttggcatcgtgccgctcgcgcctggatttacaaccttcagagtcaaagttcgccctggcaatttgaagcacttagatctcacgacgccatcagtcaagggacttatcaccctgcattatcgtcacgagccaacacaccagacgcttgacgtaaccgtgccaatgaataccaccgcacaagttgaattacctgatgatgcccacgccattgtcgttcacgaccagtacggaaaagactggaccacttcgatcgaacatgaccacgacaccttgtccatccccatgggtcgctatcagattcaatatcaagcttagtgtctaccaatcttaagttttcatgactttggtcaattttacattaaacaaaaaccagctaggcagcaattgactgtcgagctggtttttgtgtggtgagagcgagccggcgcgattagaagtcggagtgtaagcgtccttacacgcagatccctgagctggtgaacgcgttatggttgttgcggaccgaatcatctagctggttttaattggaatcgctgaccagggttgtcttcatatcaaccttcgtcgtgataaccccatcctgataaaacacatcggcaatggcgttttcttctgccacaatgctactgttggcactaatcagcgtcatggaataggtgcgccgttctaccatctttttaatcactttatcggagagattgagggttttactgagcatcgcaatgagttgcgtatgatggctattggcccaagtcatatcgtcatttagttcagtcgtcagtaacttacttaatgatgtatgggtcttggcatagctctgggttgaaatcaggaaatcacggttcttggtcaaaccggtgccgttggtcaacagcttagcaccttgattgacttgggccgttgacgtatatggatcccaggtaacccatgcatcgacactacctttagcaaatgcaaccgaggccgagctttgatccatgttcaccagtttcacatcactggtgctgagtccggctttcttgagcgcctggatgataaggtactgggcggcagtgcctttttgatacgcaatggtcttgccctttaattgctcaagactggtgatgccgctatttttaccaaccaaaataccactaccatattctttggtggccccagcggcaattaacgcaatatccgtgccagttgctttggcagtcacaggcggtgtatccccgacccgcgcatagtcgatggcaccgcttttaagtgccgtcatcaaggctgctccgtcagagaactccttgaactcaacctgatagccttttgctttcaactttttggctaattcgccacgctgccgggcaatgtcgacaggatcggctttttgatagccaatcgtgacggtctcaaggttgctcgatgccgtggcggtttgcgtataaccgtaaaccgccacgctcagccaagcgactaagcccactaacaataaaaccagtcgtaacttacgcttcatatagcttcccgccttgcattagttgtttgcggagtttcggccgtagtaccttaccagtagcattcaccggaaaagctttgacaaaaacgacttcggttgggcattcataagcggctaaatgtcgacgggcaaaattgagtaaatcaagcttggccttttgcgggtcttccgtggcgtcttggcgaatcacaacggctgtgactgcttcaccgtataagttatccggtaagccgataatcgccacttgggcaacccagtctagttcgtttaggacattttcaactttggccggggccactttttcaccgccgcggttaatcatttctttgcgccggcctttgacaaacagatagccgtcttgatccagatatccgaggtcaccagttagaaaccagccattttcaaaagattccgggtgtggctcaagataatcatgaataacgtgatcgccacgcagaacgatttcgccttcaacaaatggctttttggtaaaggtgccatccgctaatttgattcgcaactcagtccccaccggcttaccggctgaaccgattttcggggcatgaatcggattaagcgtactttgactagccgtctcagtcatgccatagccttccagaacctgggtgtgaaaatgcgactgaaaggcaaccagcttatcttctggtaatgcaaaggaagagctgcggacaaagcgtaaatgaatgttgctgttgtaagccgctaacgcctgttgattcatcagcaagattgaaatgatcgtcggaaccaccgagacccacgtgacatgattggtttcaatcgtcggccagaatcccgaggcggaaaacttcggcgcaatcaccagcttaccgcctgacaacctagtagcaagtaccgagatgacctgggcattaatatgaaacatcggcatgaccaccatcgcggtatcatccggcgatagtgcgtgactcttggcatcatgaagcgcagcatttaataacatccggtgcgtcaagccgactcgtttaggtttgcccgtggtcccggaagtgttgaggatcaatgccaagtcgtcctcttgtggccgtgcttgaggggcattaatccgataagccaactgactcgcatcggtcaggattgccaactcggaaatggtatgcaactgtactttctcccaaggaactagcggggcttctaaagctttgcccacggtcggtaacgtgatgaccgcttgatagtggtaagtttcccattccgtcagcaattccggtagtggcgttttggcagcgattggatgggcaacagccccaatttcccagagcgcctgattaagcggtaaaaagaccggcgaattcggtaaagcaattaagacttggtcgccggcgccaattttctgctcagcaaactgatcacgtaatgcggcaacatcttcttccaaatcgcgtccggtgtaccaagtattagcctcaacggatttgactaatgggtaatcacgatgattgatgagattctgagataactgatcggtgagtttgctcatgattcaggactcctttcgtagctaacaacaatgactgcggacggccaatgagccatccaaacggggaaactttgtaacaaaaccaagcgatggcaaaggaaatgccgagaatgctgagataacccagcggcaacagtagcattaacatgagattactaagatgaaccagttccaagacaccgcctaatagcgtgatggcaatggtttggcaaagatagacaccaaacgaaacttgtgcgccatgaccaaccaaacgagcaaaccagtgcgttggctgtttggcgtgccacctggcatacttttgaccaaggatggcgacaaaggcgatcatcaccacgtcatataccaacatatacggctgatgaggtgaaaccgcagcactgtgagtcaggccaagaatctgtttgttgaagccataaagaccaactgttcctaagctgagaaacaaggtgctccagccgatcaggcgctgatgggacattaaccaggttttaatcgcttgggcgtgtaggctgaataaaccaccggcaatgaagaagaattggtaggtcacaacattgacgccatatgctctaaaccaccataaccagtggctcgtgtcgatatgcggcagcccatacttgatgcctgcgacaatgagtaactgtaaagtaaaactagctagcaacaaggcgccgtgatgcttttccgtttttttgaatagccaaagcatcgccggaaataacagatacagttgtaaggttaccaagacgtaatacagataaaattgatcaccatgcaataaggcactgagataatccggccagaagttggcaacggtgaagccgccaatgcccagtagcacggcactgatcattaagatcgtgttccacaagacatagggaacgccaactgtcgtgaaacgttttttgaagaaccgcggccagttacgttgccgggagtagtagaccatcgtcagcaccagccctgtcatgaacatgaagcccatgcgtgtgaagtgaatcatgaggtgggtggcgagcaaagccgtgctggcaaaaccagaagacatttgatgttgaaatgccgtggtggtgtggttcaacaaaacgccggcaatgaagatcagtcgcattaagtcgatctcataaaggtagcgatgcttagttggctttgccgtcgtagcattcgctgttgcctgcacctgtttcatacggtcaccggctctgctagaatggccttcaatacccgcgctgccgtttgggcaataacttctggtgactcaccacgagctcctgctgtttcggtgaccaactgaccatctttaaccacgataatccgatctgccatccgtgccgcttcattaacatcatgcgtgatcaacatcgtactcagcttttgggtagtgaaaatgtgtaagatgagatcttgcatccgttgacgggtcaacgcatccaaggcgcccagtggttcatcaagcaagagcagttggggcttggccaacaatgctcgtgctaaggccagacgttgtttttgaccaccagacagttgtgccggatagccatcacttttatcggccaaaccgactgcttttaacagcgacttagcctccttaaccactgccggatcatgattcttgaacgaaacattatcaagattggttaaccacggtaaaagccgatcattttggaacatcacgcgcattaccaagtcgttttcgcgcgtcagtttgccagcagtcggggcttcaagtccggcgattaagcgcagaatcgtacttttaccgccgccactcatcccgactagtgctaaaaattcgccgggataaagattgagttgaatgtcatgaagaacggttttatcaccatagactttttcaatatgttgaagtttgacaattgggttagtcattttcagtccctccttgccgccaaccgaggaataggcgctccaagctttttgcgatcatatcggagagcttgcccagtaaggcgtaaatcaaaatgcaaagtaacaccgtatccatccgcataaattcctgtgcattggtggccatgtagcctaagccagatgtggcggagatcgtttcggcaacaatcaaggttgtccacatcacccctagcgcataccgcacgcccataagaatattggctaaggcacccgggaaaacaacgcgggtgaacaatgcgcgtcgggataagccataagcacggcccatttccaataactccggatctgcgccgacaatgccttgatacgtgttgatatacatcgggaacataaccccgatggcaaccaacgcaatcttggccggttcgccaatgcccattaagataatcatgagcggaattaaggaaaggtgcgggatattccgcaacatttgaatcggactatcaagcaaagcgcgaatcggtttgactaatccgttgatcaggccgagtgcgaagccgacactaccgccaatcgcaaacccagccgtggctcgataaagactaatggcaatattctttggcaattcaccgctttgccacagcgagatcccgtcttgaatgaccgttgacggtgcgggaatcaaggaactcgtcacccagttaaaactgaccgccgcctgccagctcatcaggaacgcgagcggtaccagccaaggcaggatctttaaccaattcacagacggtttaacccgttttttcggctcctgcgtcagtgtcgtgacttcttgcatcagcgccatctcccttaagttgatgatgttcatactagtagcggtaacttaaagctgacttaagcaagtttgaagagttcgtgacgaaaacggcatgaaaaaacgcccgcttcactgtcaataacagttaaaagcgggcattcccgtggatcagatgtgtttttgaaagagaaaatagacaattgataacaattgacgtcatctaaaaagaagccggtgaagcaaattttctcagcaagatcaattaagcagtttgccttgaccccctaaatatttggttgttaggtcaatcacgcgttgggccgtttggtcaaccaacgcttggcttgtgttttcatttccttggacgatgtaataaagatgggtggtttcaggcgtcactttcgttttttccacttgccgggtttctaagtggcaaatgatttcgttgctgtcatcaacataagcgtactcgcctgctttaaccggttccggctgaccgtctgcaccgatgggaacgaaacgctcggtgccatcagtcagccgtaaattgacattgccatcaatgtgcgcaatgtcgtgggcgccaagagcaaggtgactttgaatcgaaatgaggttgtataagtcaaccactggattaatgggcacaagctccccgcgtttcaaaattagcttcaataatgttgctggcgctggggtgttgttgcgcttaggcagatgaacagcacgatgcaagtcccaaaagccctgaataatcggatcctgcttaatctgatcgcgattcaatgtttccaaaaccgttgcaatctctgtggaaatggcttgttttagagcttgcgggtagtggtgattgtcgatgccggttagctcaacgccgcggattttgacgcctagtgctagtactttgggatcgatgatgaagttcatggctattcctcactttctgggggtgcggtggctgcgttttttaggcgggagggagttctgtttttcggttggttttgggggcgactttgcgttctataacgcgattcctggtgcagaaatttgcgtgtaagggccttagttgcaatggctaaagctcggccattgtgactgaggccgcttatgttccggcttactcccataacgcgctccccggcgcagaagtctgcgtgtaaggaccttagccgcaatggccaaagaccggccattgcgactgaggccgcttatgttccggcttactcccataacgcgccggctcgcgctcactcaaaaacagcatccatccccgttttaccaagggacgaatgctgcaacgcggtaccacccaaattcacattaccttcacaagcaatgcctcaacgacgccgaaattcatgatctttcgaggtccggaaagttaacggctccgaccgactagcctgcgttaacaaactaatgacatggcaaagctcatcttcacagtggttgcagtcatccttttccaccagccggattctctgtggaccgaaaccaccgttactcttctttgcgtctttaacgattttgaattaaccctatgctaattcgagcattaggaaaagtcaatcaacacctgacaatagtagccattaatcaacgtcaaaagttagcgccttatctatccggcagcacatgctcatcaccatacagttcagcttggctctgccataattcgcggaaataggccgagcgttgaagaagctcttctcgcgttccgatatcttcaattcggccagcttttaataaaataatttgattggctaatgtcaccgcgccgatacgatgcgtaatgaatagtgaaggggtttccttagacagccgtttgatttttgtaaataaagccaactcttttaacgggtccatcgccgcagaaggctcgtcgaggatttgataaatgcctcgcttgtactgtgctctagccactgcaagctgttggcgttgcccgccgctgggttgaaaattgccttgctgataacttccgatttcagtggcggcttgttttggcaagtgcgccacccaactgtcaatcccatttgctgccatcacctgtgcaagccgatccttatctggttgagtgctggcggtaatgttttcggcaattgcaaaatcaaaaatggcatagtcttggaataccactttgaatagtcctaagtaagcagccgctgatattttagcaatgtcatgaccgttaaataagattttcccggcagtcggttgatatagtcccagtaacaatttgactaaggtggtcttgccactgccatttacaccaatcaacgcagtcacgccggttaagtcgagagtaaaggaaatatcatgcaagacctcctcgccatccgggtaggcaaacgaaacatggtcaaaaacaatggtattttgccgttgaactggcggggtcttactcgttggcgttgttgtttggttcttagtggtcaatatctcattgacataatccatctgattctcaaagcgcaggaatcgttgccaagtcgctacgatcaaactagcagcactggtcatttgaaccacgctgccaaataaggtattaagctgccccaccggcaacaagccgcgataaattttaaacacaattaatagaaacaaagccatcgtcgcaaacgccgccattaaagcagtgatcatttgcgaaccgctgtcgttaaccaccagcttatgattggcagtcttttcctcagtccacgttgcccgatagcgttgttgaatcggcgtacctaaaccccaaatcttgatagacttaagtccttcataggcgttgacgacattcatcagaaaatagttcatttttctttccaagcccatcaaatccttgaacaacttaaaacttgcgcgcgtcagagattggtagatgtgaatgagcaatgcttcgcccaaaaataatgtaagaactgtcactaaaactaccgcggtaatcacttgactgcgtgtcgtcccagcaaccactagccaactaatcaagcctaaaccgacaattacggtcacaaccccttgaatcaggttttgtaattggctaaagaaaaccggaatcccgcctgagtaacgaaatgacgcctcacttttcatcatcttggcaaaatagcgctgagtctcaagtgtttgaaaatcaacctgctcccaagtttcatacattgccagttttagctgctcattagcctgaagcgttttaacttccaaatagcgctgaatgcatacggccatcaggtaagccccgccagccgtcccataaaaatagccaataagtgtcggtaccgtttctagatgacccgccaaaatagcgttaatgatttgggtattacccagaataatcagaagcggcgcaatggcgttcagtgtgctcatgaatattgccagcacaaaaaggcttttcccaaaccgggcaatcaagcgtcctgttgccaaggcttcttgtagctgggctttaagctgtttcatgatcgccacctccaacgtacattgaacgctgtgcttcccataaagcgcgataatcagcagaattttccaggagccaatgatgcgttcccgccgccaccacggttccgtctttcatcacaaagattttgacattccgaaccgcaagcgcaccaagccgatgagcgacaataatcgtggttttattgacgagtttttcatcgattaaatcgtaaaattgtttctcactcaaaggatcaagcgcggctgtcggttcatcaagaatattgaagtcggcttgacgatacagtacacgggcaaatagcagtttctctttttgcccgcctgacaattgaatcccatcatccgccaattcgttatcgataaaagtctgcacgccttgaggaagcccagcgacaaaagcacctaaccccacttcatcaagcaccgctttaacccgatccaagtcgatcttttcaggtgttgtgcaagcaatgttttctgcaatggtgaagtgaagtatcacgtcatcttgaaactcaacggccaaccgacgctgaatagcagcaggcgtccagtccgaaattgcttggccatccatgacaaccgatccggctgttggcaagtaaagtccgcaaagcaatttgatgagtgtcgacttgccggcaccattttcgcctacaattgcgactaactcgcttggcgcaatggaaagattgacatcgtgcaaaataggcgtcttgttgacttgataatccacatgcgtcacgttgattatgccagtgccactaaaatgttcggcatttttgtgctggtgatggcgataaggaaatgccataaattttcgaaagttatcgacaaacaccagatttttccctaccgccgcgtacgcatctctaagttgaccaaagttactattaagcgtttgaatcgccgtgataaaaaacagcagactggcaacagaaatattccgggttgccagcaaaatcagtaatgacagcgctagaccgccgacattcacgatgcgctgaccgagattcaccattaacgtgatattggcataatgtcgctgccatgccactaagcgctgaattaaatcgctaaagtgctggtggaaaaccccaagcatcgcaaacaagcgaatatctttgccggtcgaacgcttcatcaacgttcgaacaaaataattctgataactggtaatacgattctggctgtctttatgcttgaaataccattgattactcagccgctgaaacaggtactgcaagacattaagtccaaaaaccaccgcggccggccaaaaactcagtgtccccatcatcaccagcaacaccgcaatctgacaacccgtgcgcaccaaaataatggtctgatcgacaatcgccccgataccaacattagccccattataaatagcttcatacgcctgatcgatgaccgtttttcccgccaccgaatcaatcaagcgctgatcccaaccgaaaatatgctccgaaaacaccggtacataatcaaaacggaaatcaaacgtcaatattgacaggcactgctgcaagaacagatccaaaattctgataccatagacaaaaacgccagcaataaagataactaatatcgtcaacccgacactcaactgcttggtttctaacaaaatgactgcgagcggcggcagcaatgaaatcccaaccacataaacgatttcgaccaaacacagcccgcccaataaggctccgaacttgaagcgatatttgccaataaatttagcaagtatgtagcgccagttgctagcttgttccataacggccaccccctgatatcaccaaaggcttacgtttgttaaaagcaaaagtcaccattcacagtgaaaatgagcacccatgtcaagattgttttgtacaagcgcgaggataacttttcatgtgctcacactgtttaagaaatgattaaagtataacttacacctaaaaaaatgcagtcgcaaagtatgccaacctttgtgtagcaagaacagtatcatcatgactaatctagcttccgaataaatcgcatccaaataagcaatgaagacagtgccagcccaaccgcactaaggatcaagacattccaccccaagattggaatcacacggccaaataaaaagtcggccggcgggattaaaagcgcactaaaaataaacaagattgaaaaaacgcgacccagataatcattttcagtgattaactgtagcgcagtgaataccttggcattgaatctcgtaccaaagaagccattgataaacgcggcaaaaagtaacgcgggataaactctaaagatcccgggaatgagaatggacaaagcaagcaaaagtacatctatgtagtaaccattcttcccacttttttggttaaacagtgccaacaacaagcctccgacaatgccgccaatcgcctcgatactgatcactgcgctataccaatcaccatttaaatctaacgaaaccttcaccaaatatggtagtgaaagcgtgtaagcttctgcaaaaaaattaatcgtggcaattaataccagtaaccccaagattgtttctttctttcgcacataggccataccagactttaatttgggcaagatctgcaatttttctttatgactgtttttttcggtataccggatggttgcgattaataaagcggacaaaacaaacgaaaccccattgattaaaataaagccattaatgttactgtgaagcttcaataacaatgcgccaaccaacgggccaaccactttgatcgtacttgacaacgtattttgaaccgaattaaaaggctcgatttggctttcatgaatgacattaggcacaacggcttttgctgacggcgaattaaatgccaacgaaacgttaagcaccgaactcgtcagaatcaatagcagtttgcctgccacaacatcgcgaagcaaaaaggcgcacatgaaacaggtcactccgctcaacagatcagcaaaaatcatcatgtgtttgcgattaaacgagtcaacaatcgggccagcaaaaacattggcaacgataaggactataccgctgataccgttaattaatcccaaaagttctgtttgatgcgtttgctcaactaagaaccagttcatcccgtaaatatagaccatgtcgcccagtaaagagaagccgtatccaagaagcaaaggaagcgcgttttgcattcgcttaatcatgatgtaattcctcgctgttcgagcattcgatggtatttgtatgtaatgcacttatcattttaatgacctcgccagattgaattgtcgtcattgttcgcgatcaatcacgctgacttcagacgcctatcactaaaaggacaccgctagatttctttgaacaaacacatgctttccatcataaaggttaagctaaaatttatcaatcgttaattttgttcttctaatgctaggtgctggatcaaaatgataaattcgcaagtaaaccgcgaaagcttccaaatctcctaaaaatgaagcgtattttggacagcaaaaaaccacccgaacagataactgaagtgcaacaaaaaagttagacagttggaaaattagttacgcagcggtctgattccgatattcaatcggggtcaggccatttttattgagtgaaatacggtcatgattaaaccacgtgacgtaatgatctacgatttgcttcagttcctcaagatccttgattggttgccgattgagccgttctcgtttgagtaggttgaagaagctttccattggtgcgttatcatggcaattacctttacgagacatgctgggaacgatgcccatggcgtgcacctgagactggtattcacgggtttggtattgccacccttggtcagagtgcatgatgggtgtgacgccagcggggagtttcttggccaaatcgtcaagcgttaggtggagttgttctttgttcgcagagttgcgcacaatgactgtaataacctctcgactggcctcgtcaatgatggccgagatatagccccagctgtggtcaagcagtctgacttgcgttacgtcggtgtgcaggacagcgaagggctcctgggcatcgaattgttggtgtaacaggttgtcgttcacggtgcctacttttcccttataggagtgatagccgctagtatggcgagaatacagtgtgacactaagattcaattgccccattaaccgtagaattgtattgggtgagcatttaaagccggcttttcgtgccatcacatgaatacggcgatagccataggtctcatatgagtcatggaaggtcttcttgataaataccttcaaggcggcatatttatccggcttattcttgcggtgcaagcggtcatagaaagtagcccgaggcaactgtgccaatgccaataattccttcaatggatagtcatgccgtaacgcgtcaactactgctgttttttgggcggcagattgttcttcgatacggcccctaatttttttaaaaagtcacgctccattcgcgtatggtataactcgccgcgtaatttcaggatctcttgctggtaagcttccttctcactaagctcaagcttcttaacttgtttgggtttcttatgtttcactgtagaccgccttcctcgcggtttcggacgcaacccagccactccctcagtcttgaagatctttgcccaaacagtcacctgcgaagcgttgatcccgaaatgagcagccaccgatgccacaccttcaccactggtttgataatagtctaccacggccaacttctgttccagagaataaaatgtcttcgtatgctttcgctgaagagattcaagtccatggacttgggcttgcttaacccactctcggactggtttcgttgacgggatactgtatttagtgcaaaggctgttataggaaacccgtccagaaagatactcctgtacaaccttcaccttgaactcacttgaatatttagtcataaaaataccccacaatcattagagtatctgtctaacaattatggggcacttcataactgtccaggtggttccaaagttgatgcatataatatgcaccattttgccggtcgctctcggcgaattaacgcttggagaactgactagctttacgagccttcttcaagccatacttcttccgttccttcatacgagggtcacgggtcagcatgccggccttcttaagcgggccgcggaagtcaggatcaacggtcaacaaggcacgggcaatgccgtgacgagttgcgccagcttggccagagaaaccgccgccattaacgttaacaagcacgtcatagctgccagtagtttcagtgatgccaaatggttggcttaaatcggtgatcaggttttcatatggaaggtagtcgcgaacgtctttaccgttcattgtgatcttgccggtaccaggaaccaaacggacccgggcaacggagttcttgcgacgacctgtacctgcgtattgtacttgtgccacagtaattgcctccttagattaagtttgaaatgtcgagtacttctggcttctgtgccaaatgtgggtgttcctccccagcatagacatgaagcttcaagaattgctgatggccaagagtgttcttggtcgggagcatcttcttaacagagtattcaaccagacgagccgggttgtcccgcaagagatccccagcgatttcatgtttcaaaccacctggatgctgactgtgacgatagtaaatcttgtctgaggcttttttgccagtcaactttaacttagaagcgttgataacgatcacattgtcacctgtatcaacgtttggggtgaattgcggcttgttcttaccacgcaagatcgaagcaacgacagatgataaacggcccaacgcgatatccgttgcgtcgatcacataccatttacgttcgatttcacctggcttagccaaaaatgttgtacgcacgatttgtttcctccataattctgtgcttgtttgaacacgttaagtttccggggcttatcgtggggcaaacaataccagctactagaataccaacgattagcgctcaagtcaatgtaaaattcagtatcctactataaagttgcactcgcagttcgcgtttttatagcttcaaattgttccttgccccaaatgtgcttgtctacctcaaatactgcttaaaatgctgcttccattaataactcgtctgcaacactccactcgatgcttcaatccttgtgtccttccccattggcttcgggccgcaaaacaccggtacaaaacatctgcaaagcacgatcaagcgacaattgattttgaaaagtgttcccgcgactggtaccaacagttggctgcaaataagcggctaaaacggttaaaaaatagagggtcacgtcacgcacgcgatatgtcggcgccagctgttcgtcaaaggtgctaaaaaaccgatctaacggcgacaacaagccaacttgccatgcctgaaaaacatccgcctgtgccttagaacttaaattcccgacatcatgtaagacgagttgcaagttcatcatgttgtcatcggtgagtaaatgcccgaggcgcttgacttttttgccaaaattttgggcatctatttgttcatgggcaattttacttgccatgtcttcacttaccgccatgacaacagcaagatacaaggcctctttggttttaaaatagtgatacagcagcggttggcgaacgtcagccgcttcagcgatcattcgggtggtcaccgctgtgtaaccgtgattcataaataatacctgagcggcggttaagatccgctgcacggtcgctttcttctggtcatttcgttgtgtcatttttccaagcccttttcatttatcatatgataaacaagtgatatactgattgtgcaaaactaaatatggaggtgatcgtgatgttccttgcgtataaagagattattcacaacaaagcccgctatctgctcgtcatggcgacctttgttttaattgcctatctggtcttttttctaaccggtttggctacaggtttagcgcgtaacaatcgcaccgccattgacgcattgccgggtaattacgttctcctgtcgaaatatgccaacaaaaatcttctgagttcgacattgagcgcggatcaaatcaccaaagtcagcaccaagcacaccgccgtcctcggccaagtggcggttgttgcggaaagtaccgcgaatgataagaaagtcaatagtaacgtctttggcatcaacctcaacggcaagctgaagccgactgtcacaagcggacgcctgccaatccatcacaacgaggtactcgcggatgacagtgtgaccatttatggcttgcaccaaggtgatcgcatcactttaaacggcagcagccaaacgtatcggattgtcgggttgacgcatgaccggcgcttttacacggtacctgtattttacacaactttaggcacttttcggcagctaaagttcggacagcgccaagttaaacaggcctccgcggtgatcagtacaaagccgtttaaaaatattccggccaagacccaatccatttccaaagcaaccttagtcgaaaacatccccggctatacagctgaaacgtcgacttttgccttaatgatcggagcaatgattggcattatgctcttaatcattggcatcttcatgtacattttaaccattcaaaaaattgccatgtacggggtcatgcgggcacaaggtattcgcacgcgggcaattattgctgctttgttctggcaaatcctgatgcttgcggtcaccggcgttgctatcggtgccggactgttaggattaacgcaatttattttaccaaaagccatgccattttatgctaatccgccgctttttatcgcgatcgctgccgccttaattttaatgtccctggttggcgggttattctcactacgccggattttgcacattgatcctttagctgcgattggaggtgagtaacatgaccacactggttcaactcaagcaagtcagcaaagtttacggcagtggccatacggcggtagtcgccttgcatcccaccgactttacgctgcatgccggtgaatttgccgccgtcatcgggccatccggttcaggcaaaacgaccttgttaacgattatcggcaatctccagcaacccagtgacggtcagattgtgattaacggtcaggacaccacgcactttaatgaacaccagcggactgatctgcggtttaatacgtttggctttatcttacaagccagcaacctaattccttttttgaccgttaaagatcagctagccttagtcgaccgtttcaatcatcatcgccaacacaaacgctccatgaccgagctctttgacctactcggcattagcgacctgaccgccaattatccgtccgctttatccggtggcgaaaaacagcgggttgcaattgcccgtgcgttatacaacgacccgaagattatcttagccgacgaaccgaccgccagcctcgacaccaaacgcgcactgcaagtcgtggcacttctggctgatattgcccacaaaaccaaacgcggcgtcatcatgatcacccacgacacgcgtttgctggatgacgtggatacgctatatgaaatgcgcgatggtcagctcaagcaactcagagacagagcggccaaaaaagtcacaccgaatccggcgtagatttaatctttttttaatattttaagtttgccgctattccgcatagcagcagcatctaagcgctatcagataggccaaattagcactcttttaaaaacagtgctaaaaatttgcatcatcgcccagcaaaaggcttataatgaatttgtatcaaaaatgagtttatatcatggaggtaatcattatggcaacagtagatcctgaaaagacattgtttctcgatgaaccaatgaacaaggtatttgactggagcaacagcgaagcacctgtacgtgatgcgctgtgggattattacatggaaaagaacagccgtgataccatcaagactgaagaagaaatgaaaccagtcctagacatgtccgacgatgaggtcaaagccctagcagaaaaggttctcaagaagtaagatcacaaaactaaacatcatgaaccgcgcccctgcaaaaagggacgcggttctttttgggtgagcgcgagcaggagcgcttagaagtcggagtgtaagtggcctcagtcgcaatggcctgggtttggccattgcgactgaggtccttacacgtagacttctgcgactgcgagcgcgttatagaaagtatggcaaaaccactaattgcctctaatagaatgttctccgcaagcttccagcctcttctcttggccattgcgcctgatgtccctacacgcagacttttgcaccggtgaccggcttataaaaagtacgaccaggcccgccaattaccccaagagaacgccctccacaacccaccaaccacaaaacctcaaactcactatccaccttccccccttgaccctaaccccacgtcaccgtttaaagttataattgatccaagggaggccagtcaatgacatactcaaccaagcaactcgctgacttagctggtgtgaccatccgcacactacgctactacgacaaaatcggcttactaaagccaacccgcaatcctaacaatgattaccgccaatacacgcaagctgaggtcaaccgcctgcaggtcatccgcttcttacaacttttcgaaatgccactcagccaaatcaaacagctgcttgacggtccaaccgaccaattaaccgccgcgctcatccggcaacggcaacacatcaccgccaaacgcgaccaacttagcttactacttcaaaccttggatcaaactttagaaaaaggggttaacaccatgacagacgacgaaaaatttgctgcttttaagcaacaagccattcagcacaatgaagaacattttggtaaagaagtccgggaccaatacggagaggatgtcgtcgaagccagcaatgagaagtttcgcaaaatgtcccaagcacaagtcgcacagctgaccgcactgcaacagaagattctcgaggaactaaagccactcgttggtacgaccgattacaacaccgctgccgccaagcatcttttcaaactgcacaaacagtttctccaactcacctggccatctgaacaatattccgaaaaagctcaccgcggtctggcagccatgtacgtctccgatccgcgtttcaccaagtactatgaagacggcacaggtaaaaaaggtgcttccaaaactttgaacgccatcattcgccattacacgcgttaacgcaccaagatttcatttcgtgtgcgctgtttaagcattttggcgtgactaaccagctgtcaatttcagcaggatgaattcatttgcaaagaggctctaaagactgacctaccagtccttagagcctcttttggttgcatagtttgtcaactcggtacttcaaaatgcaaaagatcagggaaataccacaaagccaataaaaaagtttgtgtgtgagggtcaataataaacttccttcaagtacaatcccgaagcaggggccgtacctcttgcctgctgcctatccttaacttcaaaaagccgttgaaaatcatgaacatcgcgccggccgttgccaatctccaaagccgttgccactaaaatccgcaccatgttgtacaaaaagccattaccataaaactcaaaaaccaattcattggcagccggatcttcttcaaccgtcgcctcataaattgttcggaccttatctttaatcacaccgccactagctgcaaaactcgtgaagtcatgcgtgccaactagatctttcaacgcaacctcaatccgcttgacatccaacttataaggatagtgtcctgtgtaaaggcgattaaacggattcgtataatagccacgcgccacccgataccgatatcgctttcccttcgctgaatagcgcgcatgaaaatccgccgcgacaatttcagcttttaggatttcaatatccagtggcatcagtgaattcattgcccgcaacatcgactcagccggaatatttcccgggtaatcaaaactaatgacctgtcctagcgcgtgcacgcctgaatctgtccggcctgagccatcaacatgcaccggttgcccttttgccattttcgtcagagctttttgcagaacaccttgaaccgttcgctgcttgggctgaacttgatagccggcaaagttggtgccatcgtaagccagtgtcactttataatgcgtcaatacagtggttcctttctaatacgcgcgcagtaacagcaaaagtccggttaagacaagcataccgcccgcagcaatccagtcacgctgatgataacgtaagatccgatacttggttcgattgtcgccgccttgatacccacgggcttccatcgctgttgctaactcgtcagcggtggtgaagctagaaacaaacaacgggatcagtagcggaacaacagctttcatttgctgaaaaatattaccttcaccaaagtcaacgccacgcgctcgttgggcattcataattttagtggtttgatccatcaatgtcggcacgaatcgcaaggcaatttgcaaaaccaaggccagctcggtcaccggcacgtgaataacccgtaacggttttaacagactctcgaccgcatcagccagtgaaagcggctgggttgttagcgtcagcaaggttgacataaagatgatgagcacaaaacgaacgaaaataaaggccccattaatcagccctagcttcgtgatccataaccaaccccaatgccaataaaccgtaccgccacgaacaaacaatacctgcaaagcgacggtaaacaagatcagccagattaacggccggacgcctcgcaagaagaagccaagtttaataccggacagccaaatcatgaacaaagtcgccacaaacatcattaaatacgtttgccagttgttggctagaaaaacaatcccgatataatagaaactcgccatcaacttggtgcgggggtcaagctcgtgaatccatgaatggccgggaatatagcgtccaagtaatagtttatccacgctggccacctccgatctgtggcagcaattgatccgccaactcggcttcggttaacggctgcggatcaaagtgaaacccttttgcagtcaattgttgtgccatttgagcggttttaggtaaccctagctgattcgccttcaaccaagccgagtcggcaaagatctcccgcggcgttccggttttgatcaaatgtccctttgccatcacccaaaccgtgtcggcataatccgccacatcgtccatctggtgggtcacgagcacaattgtctgcccttcttcacgatgcaggcgttcaaacatttgcatcatttcgtgccgcccagccggatccagaccggctgtcggctcatccagcaccaaaacttccggttgcatggccaacacaccggcaatggccactcttcgcatttgcccgccagacagatcaaatggcgacttttctaatacatcatgcggcagaccgaccatcgtaatcattttatccgccaacgctaaagcatcctgctcgctcacaccaaagttttgcggtccaaaagcaatgtccttagccacggtttgttcaaacagttgattctcggcaaactgaaaaaccataccaactttttgccgcaacggtttcagattcttattactcgtttcattagtgatgaccttatcgccaatcgtgacagttccggaagtcggctttagtaatgcattcaagtgttgcaaaatggtcgacttgcccgaaccggtgtggccgataatcgccgtataactaccatcatgaatggttccggaaacatctttgatcccgtcaccagcgaaaggcgtacctgcctgatacgtaaagctcacatggtcgaatgtaatgtccacaggtagtctaccaacctttcattgtccaaatatgcttctggcattgtgacaccgcgctgaatcaaggcgtcttttaaccgctcggaatacggcacatcaagccctaagcgcaataggtctgtcccatgtgcaaagatctcgctaggcgttccgatttcgttaatcttcccgtcattaagtaaaataatccgatgcgcagatgccgcttcatcaatatcatgggtaattgacaaaacggtgagccccaattcatctttgagttcccgaatcacacccaacacttcctggcgaccggccggatctagcattgatgttgattcatccaggataataatctccgggcgctgggcaataatgccggcaatcgccactcgttgcttctggccgccagacaaccgcgccggctcccggtcagcaaaagccgtcatgccaacgcgtttgagggcttcatccacccggcgaatcatgtcatctcgtgggacaccgcaattttccaatccgaatgccacatcatcggcaaccgtcgcacccacaaactgattgtccggattctggaaaacaatcccaaccttggcgcgaatatcccacacggtttcttcgctaagcgtcatcccggcaacttcaaccgtgcccgattctggcgccagcagtccatttaaatttttcgccagcgtactcttaccgctaccattatggccgataattgccagccactcacctttagccacatcaaacgacacatctgtcagtgcttgacgttttgcttccggataagtgtaattcaagtgttgaacatgaatgacgttgcccacaatgccccttcttcctacgctttgtataccgaacaatgataccatattttaccgaattgttggacgatccctacttcaaatacgagatgtaccgctagtcgtttcagtgaccgccgggactaattagccaattcaatcatcttttcgtaatatccggatcggtacaaagaaacccgaaaaagaccgtaaaaatcaacgcaatcagccctagaagccatgcctgtacttgcaccattccaacatgagacatcacaatcccaaaccgactctggccattgacaaccaattgccgatagaattgactttggataaggaaaatgagccaaaacatgagggctaagcgtccaccttttgccgataaacccacaagtagcgaaatactaccggcaggcatcacccagctaaagttaagaatcacctgtaacaaaaacccatccaatgagtggggatgcgtcagattggcaagcgggtaccactgcgccaaaaccaccacgaggaaccataaaacaataagcggtgtataggccttcattaaagaaaatggtgtcttgcttcgtctaaagcgtgctcccattaaatagccacataaagccgcaaaaagccacagatacgaagaccagtcgatagtcaccgccccattgtccaaccgataaacagtgggaataaacagcccacctatactcatatttgcaggcgtaaatgcgagtatcaaaacgacaaagaagattgaaaggattgtccagccgccaaccaacaataagccaagttgcagcggcgttcgatattgaaaccaagtacgcatattagcatgacctccattatgtcgcagtatacaggaaaaatcggattagtagtgcgcatggagctagaaagtttggcgaattgaggaccaatttaccgcgcgtcatggctggctttgttttaaggctaatgcttttttaactcgaccccagtatttaaaaagaattctcttccgcgtgtcggcgaagagaattctttttagttgatagatttaattacggcaacaagtttggttacgcttgctttcgaggcgctggttcatacttcatcataacgcgctcaccagcccagcaatccacatgtaagagccatgaacaccatggtcaaaacgggtatcacgtccatggtcgcttacatgccgactgctgatcgcaatagtttgcgattgcacaaaaaaatcatttaatgatggagacaccggttgcccggtgctctcaagctagactaagcaggattaaacctgccatcatcgtaacgctccatcgatcaaatgatcaaagttggttgacctcgagggccagcccttttaactgaatttagacgagctcaatgataaccattggtgcaccgtcaccgcgacgtggcgcagtcttcaaaatgcgggtatagccgcctttgcgatctgcgtattttggtgccaagtcactgaacagtttttgtaaagcggacttcacaatcacactgtcttcttgttcttcgacactcgcaatttcgttgcgcacataagctgctgcttggcggcgtgcatgtaaatcgccacgcttgcccaaggtgatcattttttcagcagttgaacgaacttccttagcgcgggcttcggttgtaacgattcgttcgttgatcagcagatccgttgtcaaatcgcgtagcattgccttacgctgtgagctggtccgccctaatttacggtaactcatggattggcctccttttcgaaattagtcttctttacgcaatcctaagccaagatctgccaacttgtttttaacttcttcaagtgacttgcggcctaagttacgaactttcatcatatcggcttctgttttgttggttaactcctggaccgtattaatcccggcacgcttcaagcagttgtaggaacgaaccgacaagtcaagctcttcgatggtcatctcaagcattttttccttgtgcgtttcttctttttcaaccataatttcagcgttcttagcttcatccgtcaaattgacgaaaatatccaggtgttcagtcaggatcttcgctgctaagctgatggcctcacgtggcgagattgagccattagtccaaacatccagcgttaacttgtcgaaatcattccgacggccaacacgggtgctttcaacttgatagttaacccggctgatcggggtgaaaatcgagtcgatcggcaaaacaccgattggcatgtcatcagacttattctggtcagctgccacatacccgcgaccctttttaacggtcatacgtacatggaagtgcccgccgtctgcaacagtacagatatactgttcaggatttaagacctcaacatcaggatcagcgacgatatcagcagcagttaccttagccggaccgttgacatcaatttcgatgttcttatcttcatcagtgttcatcttgagtgccaatttcttgatattcaaaatgatctgagtcacatcttccaatacaccatcaattgtggagaactcatgaagtaccccatcaatttgaatgctgctgacagctgcgcccggtaatgaagaaagaaggatccgccgcaacgagttacctaacgtagtaccgtagccgcgttccaacggttcaaccacaaacttgccatagttggtgctttcgtcaactttggtaatgttcggcttttcgaattcgatcatctagtttgtacccctttcaaaacgagaagtgaagatttgtctgcctgaccgccataacggtcgaagggtaacaattaaacacgacgacgctttggaggacgagaaccgttatgcggaaccggtgtaacatcacggatcgcagtaacttcaagacctgttgcctgaagtgaacggattgcagcttcacgaccagagcctgggcccttaaccgcaacttcaaccgacttcatgccatgttccattgattccttcgccgcagcttcagcagccatctgcgcagcaaacggtgttgacttacgactacctttaaacccgagtgcaccagcagaggaccaagcgatcgcattgccgcgagggtccgtgatcattactaaggtgttgttgaaggttgagtggatatgagccacgccagattcaacgtttttgcggacacggcgcttccgcgtagtttttctacctgccatcgatcaatgacctcctttaattattttttcttacctgccatcgttgcttttttccctttacgggtgcgagcattgttcttggtattttgtccacgaaccggcaagccacgacgatgacggatgccgcgatatgaaccgatttccatcaatcgcttgatgttcaagttcacttcacgacggagatcgccttcaactttgtatgagtccaaagctgcacgaatcttgtcttcttgttctggggttaggtcatcttgacgaacatcttccggaacaccggcagtcttgagaaccttttgagcggttgtcttgccgacaccatagatataagttaaggcaatgacaatttgcttaccacgtggtaagtcgacacctgcgatacgagccatgtacaatgacacctcctattttttaatttatattatccctggcgttgcttatgctttgggtttgcagagcagataatcatgacccgacccttacgacggaccactttgcagtgctcgcacatctttttaacagatggacgtactttcatgagaatttagcctccttgagttggcaactacttgaaacggtatgtgatccggcccttggtcaaatcataaggtgaaagttcaaccgtcaccttgtcacctggtaaaatgcgaatgtagtgcatccgaattttaccggaaacatgggcgaggatctcggcaccattttcaagcttgactttgaacatcgcgttgggtagggtatccgtcacggtgccttggatctcaattacatcgtcttttgccacgaagtgtttcctcctaaaaattattggttctattaacgcgcgaaaagggtgaggccgattggcactcaccgcataccgcgatattgtaccataattcttcgactttgaaaacagtcatgaggggcgtgcaatcgtccaagcacttactttgccacagcagccaaaatcgtcttgatatctgcaaacaccttatcgatgtcttgatcaccattaacagtgtggagcaaacccttcttttggtagaagtctaataatggcgtattcatctcgatgtttactttaagacggtttttaacggtttccggcttatcatcttcgcgttggaagaattcgtggccgccacagcgatcacatgtgccggcaacctttggcgggttgtagattttgtgataagttgcaccacatgtcttacagataaaccgaccagacaagcggtcaactaactttgcaggcgcaacatcaatattgataacagcatctaacggcttcttaagatcagctgtgatcgtttcgagtgcctctgcttgttggatggtgcgcggaaagccgtcaagcatgtagcccgcatcggtatcggactcagcaaggcgctccttgacaatgccattggtaaccgagtcgggtaccagttgacctttatcaataaagccttttgcttccttacctaatgctgtgccagcagccatcgcggctcggaacatatctccggtggaaatatgtgctatcggataagtatcctcaatccgttctgcctgcgtgcctttccctgcaccgggaagtcccattaaaatgagattcacgttgcatcctcctctaattgtacgcgctggcatgtatttaaaactgctgtgaacagcttctaaacgatttaacgttgaaacttgccagtttgtacgctgcttttaacgcgtcaacctttgaaaatggctgacttctgatatcgtttacttcttatcgttcttaaccaaatcgccgcgaataaatccgacgtactcacgcttcatgagtaagccgtccaattggcgaaccaattcaatagcggtcatgacaacaatcaacaggctcgtaccaccaagtccgattgattgcggcagcccccaaatgttggcagccagttgtggcagtaaggcaaccaaaccaaggaacaaagcacccactgttgataagcgcatgagtagccgtgagatataattctcggtttccttacccggccaaacaccgggaatatagctgccttgtttggttaagttttctgcgaccttctcgggattaacctgaacgaacgcatagaagaacgtgaacagaataatcaaaagcgtatagatcgcagttccggctggcttttgcatattgaagacattagtcatgacttgataccatccgtcagtcccatgattcttctgaaaagccattaaaattgtttgcggcgtcacaataaaggaactcgcaaaaataaccgggataacaccggcaacgttaactttaagcggtaggtaactgttgctgcccgcgctggtaacgcgccgagtgtactgaattggaattttataattagcttgctgcacccaggtgacaaatgtgataaccaggatcacgatgactgccaaagctgctaaaaacgcaattcctttccagatttcagaaccagagtatacctgaacgttatcccgatataactcttggagacctgaaggcaggcgtgccacaatcccagagaagatcaacagcgaaaccccgttaccaaggcctttatcagtaatctgttcacccatccacgtcagcaacattgtgccgcctgtaaggatgataccgattgtgatataggtactaacggacggatttttaaccaagcccatcgaacttaacgtttgaaagccggccgtaatcccaattgcctgaaagaacccaaaagcgatggtcagataacgagtaacttgattcagcttacgccgaccgacttccccttgcttgctccactcgacaaatttcggaacgatatccatctgcagcagctgaaccacaatttgggccgtaatatacggcgaaacccccatcgaaaagatggagtattgtgccaatccgccaccactgacagtatccagcagtgagatcaagcctgtcgagccgattgactgcagcgccttggcattaacaccgggaaccgcaatcagtgtacctaatcgatagaccaataaaaccgctaaagtgaagaggatcttgttacggatgtctttgaccttgagcgcgttttttagggtcctcagcattagatcacctcaatcgaaccgccagctgcttcaacggcagcttttgctgcggttgaagcttttgcaaccttaatggtcaattttttctcaagtttaccgtctgccagcaacttaacaccgttcttttcgttcttaacaatcccggcatcgatcaaggctgctggtgtaacttcagcaccgtcatcgaagcgattaagatcggaaaggttaacgattgcatattctttgcggttaatgttgttgaaaccgcgctttggcatccggcggaataatggcatctggccaccttcgaagccaagacgcgtcttgccgccttgtcgtgccaattgaccttttgtccctttaccagctgtcttaccttgaccgctagaagtaccacggcccagacgcttgcgggcatgacgggagccgacactcggctttaattcgtgcaattgcatactcttgggcacctccttgtcgaaataatgtattaatctttgatttcttcaaccgaaaccaagtgtgaaatctggaaaatcgcaccacgagtggctgcgttgtctggtttaatcaccgagctgttcacccgatttaagcctaattccttcacaattttacgttgcttaggaagacggtgggcagcactacgggtcaaagtaatcttcaattgagccatgtgtttacctcctagtcttcaagcgatgacgcagaaacgccgcgtaattcagcaacttgttcgcgggtgcgcaactgtgtaagtccatccattgttgcccgaatcatattgattggtgtgttacggccaagggatttgctggtgatatcagcgattccggcaagttccataacggaacggatagcgccaccagcagcaaccccagaaccttcttcagcaggcttcagcaaaacttcaccagcgccgaagtggccgattacttcatgaggaatcgtggtgccgacaattggcacttcaatgaggctcttcttagctgcgtcaacagctttacggattgcttcaggtacttcttgggctttgccggttgcgaagccgacgtgaccgttcttatcgccaacgattgcaattgctgcaaaccgtagacggcgaccacctttaacaacctttgtaacccggttgatggcaacgacctggtcttctaagtccaattggtttggatcgataaatgatgccatgtgttggttatcctccttttttctagaattcgaggccattttcacgtgctgcttcagctaaagcggcaacgcgaccatggtacagataaccaccacggtcaaagaccacaactttatgaccatctgcaactgcgcgcttggcgatcaatgcgccaacctgagcagccgcgtcagtcttgttttcaggatctttaatgtccttatcaagagtggaggcacttgctagcgtcacacccgctacgtcatcaattaattgcgcgtagatgtttttattggaacggaaaacgttcaagcgtgggcgctcgctcgtaccagaaatcttgcctcgtacgcgggcgtgacgccgttgccgagtcttattcttatctggctttgaaatcacaatgttcacctcttgttaaatttgttgaaggttacgactacttaccagtcttaccttccttacgacggacatgttcgtcaacataacgaatacctttacccttataaggttcaggtgcacggacggaacgaacaacggctgcgaattgaccaacaacctgttttgagatcccactgatgatgatctgagtggtgcttgggacttcaacagtaacaccttttggcgcggtcatttcaactggatgtgagtaaccgacgttcaaaacaagtttttcgccttgcttctgcgcacggtatccaacaccaaccagcttcatttctttcttatagccttcggtaaccccaacgaccatgttgtttaagttggcacgcatcgtaccatggatggccttgtaggaatcatcgggacgggtgaaattaatttcgtcgccttcctgatgtaattcgatttccggggcaaaatgacgggtcaattcgcctttagggcccttaaccgtaatattgtcaccatctttggtaacagtaacaccggctgggactttgatgactttataaccaatacgactcacttatcggcacctcctttttgatgttatgaattaccaaacgtaagcgagtacttcgccgccaacgtttttggcacgagcttccttatcggtgataacaccttcggaagttgagataattgcaatccctaaaccgtttaaaaccttaggaacagcatcactcttaacgtatgagcgcaaacccggtttggaaatccgcttcaagccggaaataacccgttcattgttcttaccatacttcaagaaaatgcggatcacaccttgcttgtcatcatcgataacttcgtagtcacggatgaacccttcacgtttaagaatctcagaaatgtctttcttcatctttgatgcaggtacgaccaaggattcgtgacgcaccatattagcgttacggatccgggtcaagtaatctgcgattggatcggtcaagaccattgatttaacctcctttgtctagtgattaccagctagctttgcgcatgcctggaatttggccggcatgtgctaactcacgaaggcaaatccggcagagtttgaatttacgatatacggaatgcggacggccacaccgttggcaccgcgtatattcctggactgcaaattttgcaggccgtttgtttttagcgatcattgacttcttagccaagtagcggacctcccttatttggcgaatggcatcccgacttgcgtgagcaactcgagtgcctcttcatcagtatttgccgttgtaacaatcacaacatccaacccacgaacccgattaaccttatcgtaatcgatttctgggaagatcagttgttctctaacacccaatgtatagttcccgcggccatcgaaggacttaggggaaataccgtggaagtcacgaacacgcggcagggaaacattgatcagcttatctaagaaatcatacatgcgttcgccgcgcaatgttaccttggcgccgattggcataccttcacgtaagcggaaaccggcaatactcttcttggccttggtgatcagcggatgctggccagagattagcgtcaattcttctaccgcttcatccaataacttagcattctgagttgcatcaccaacacccatgttcaaaacgatcttttcaatcttaggtgcctgcatggtgctcttatagttgaacttgcttaccaatgcaggggcgatttctttgctataacgttcttcaagacgattctccatgaaaaagtttgtcctccttccctattatttatcgattgcggtgccagacttcttagcaatccgcactttattgccatctttaacttcagaaccgatgcgagtcggcttgttggtttcaggatccagaagcatcacgtttgaaacgtgaataggtgcctctttgtcgatgataccgccttgcggattcgtattgttcggcttctggtgcttcttgatcatgttgatgccttcaacaacgactttgtcagcgctcttgaggactttcgtgatctggccttctttgccggcatctttgccgcgcatgacccgcactttgtcaccagttttgaacttcatgtatcgcacctcctatttggtcagaatgattaaagcacttcgggcgctaaggagacgatcttcatgaaatcgccgtcacgcaattcacgtgccacaggtccaaagatacgagtcccacgtgggctcttgtcagcattgatgatgacagctgcgttctcatcgaacttgatgtaggaaccgtcagcacggcgagcgcctgacttggtacgaacaatcacagctttaacaacatcagccttcttgacaacgccacctggtgttgcttgttttacagttgcgacaacaacgtccccgatattaccggtcttgcggtatgaaccaccaagtaccttaatgacaaggatttcgcgcgcgcctgagttatctgctactttaagacgactttcttgctgaatcacggatttggtcctcctttcactctaaaaatgattagatgataactgccttttcgacaatattcaataaacggaaacgcttattgcgtgataaaggacgagtttccgcgatttggacaatatcgccaactttagcgctattgtcttcgtcatgcgcataaaacttcttggaatacttaacccgtttgccataaacagggtgtgtgttatatgtgctgacttccacggtgatggtcttgtccattttatccgagaccacgcggccttgataaactttacgagaattacgttctgccaaggtaaatgtctcctttccgattatttattgagttcctgttgccgaaggaccgttttgatccgtgcaatgtttttccgaacttgcttcaagcgagcggtgttttccaattggccagtcgcctgttggaagcgcaagttgaacagttcttctttatattgcttctctttgtcgagcatctcagcagtggttaatgcagtaatttctttagccttcatttgattgcccacctacttcctcgcgtgaaacgatcttggtgcggattgggagtttgttggatgctaaacgcaaagcttcctttgcgactgcctcggacacgccgccgacttcaaacatgatcttttcacgtttaacgactgcaacccatccagttggtgcacctttaccattacccatccggacgccgacacctttactggtgtaggacttgtgagggaaaatgcggatccatactttcccaccacgcttcatataacgggtcattgcaacacgcgctgcttcgatctggcggttggtgatccaatgggattccaatgcttccaaaccatattcgccgaagtcaacgttcttgccgcccttggctgcaccgcgcatcttcccacggaattcacgacgatgcttgacacgcttaggtactaacattgattatttccctcctttcgcattattttgctgtggcttttcaggtaaaatttcaccacgattgatccaggttttgatcccgatccggccataagtcgttgctgcttcttcccatgcatagtcgatatcggcacgcaaggtatgcagcggaaccaaaccttcattgtaatgttcacgacgtgcaatatcagcaccgtttaaacgaccggaggcttgggttttgattcccttagcaccggcacgcatggtacgttgcattgcttgacgcattgcacgacggaatgcgatccgttgttcaagctgacgcgcgatgttttcgccgacaagcttggcatccaaatcaggttttttgatttctacaatattgatgtgaacttggcgaccagtcagcttattgagctgcttacgcaagttttcaacttcagaaccgcctttaccgataaccatacccggtttagcagtatgaacggaaatgttgacgcgctttgcagcacgttcaatttcaatacgtgatactgaagcatcttgcagcttcttattgatgaagtttcggatttcaatgtcttcatgcaagtagtcagcaaagtctttgtctgcataccacttggcatcccagtcacggatgacaccgacacggaaaccggttggattaatcttttgacccacgcgttatccctccttatgcttctttttcggatacaaccacggtaacgtggcttgtccgtttattgatcggtgatgcgctccccttagcacgaggacggaaccgtttgagggtcgggccttcgttgacataagctttgcttacataaaggttttgtgcatctaagtcatagttatgttctgcattagcaatagcagacttgagtaccttttcgatgatcggagaaccggaacgaggtgtgaactcaagaattgccagtgcttcagcaacatcgcgaccacgaatcaagtcgattaccaagcgcgctttgcgagcagcaatccgaaccgtcttggccgttgccgttgcagacgtaatttgatcagccatgaatgttgtgctcctttctagcgtgctgttgtcttcttgtcatcggtgttgtgaccgcggaaggtacgcgtaggaacaaattcgcctaacttgtgaccaaccatgtcttcactcacgaaaaccgggacatgcttgcgaccatcgtaaacggcgatggtgtagccaatgaaacttggaaaaatagtagaacgacgcgaccatgtacgaataacggtcttcttgtcgttatctgcctgcgcttcaatcttcttcaggagatgagcgtcggcaaaaggtccttttttaagactgcgacccattgtgtgacctcctttaatcgatgtaacacttcaatgtgtttacttcgtcttgcggtgacgaacgatgaatttctcggatttagccttgtgatcccgggtcttcttacccaaggtcttcttgccccaaggtgataatggtgacggacgaccgattggtgctttaccttcaccaccaccatgcgggtgatcgttagggttcataactgacccacgaacagtcggacggaagcccaaccagcgcttacggccagctttaccaatgctaatcaattcgtgttgttcgttaccaaccgcaccgatagtcgcacggttctcggctaataccaagcgaacttcgccggaagcaagtttgatggtaacgtacttatcattatccttacccagtaactgagcggaaacgccggcagaacgtgctagttgtgcgcctttgccaggtttgagttcaatgttatggatggtggtaccagctgggatgttctttaacttcaatgtgttgccgactttgatgtcaacatcgtcaccggagtaaaccttatcgccaaccttaagtccctttggtgccaagatgtaggacttaaccccatcttcataatgcaataatgcaatgttagcggtccgatttggatcgtattcgattgctttaaccgttgcggccatattgtctttattgcgtttaaaatcgatcacacgataaaactgtttgtgaccaccgccacgatgacgcacagtgatgtgtccgtgagcattgcgccctgctgtatggctttggctgaccagcaaagtcttttcaggctttgtcttggtgatttcagcaaagtctgagccggacatgttgcgccggccattgcttgttggtttgtacttaataatcgccacgtgtttaacctcctataacaaatttttgttacttgttatcgttatcttcatcagcgaagatcttgatttcttttgaatcggcgctcaaggcaaccaaggccttacgacgacgacgcgtcatgccttcgtaacgaccttggcgcttcttcttgccgcgaacgtttgcaatgttgacattaacaaccttcacgccgaagatttcttcaactgctttgcgaacttggggctttgttgcatgaattgcaacttcgaatgtgtatttacggttgtccatttcagccatcgattgctcggtgacgatcggacgtaaaatgatatcgcgtgcttccattatgcaagcacctcctcaatcttttggagcgcagattgggttaagatcaatttcttgtagttaacagcgtccaagacgttgataccctctgcaggaacaactttcacattcggcaggttacgtgcagctttggcagcaacatcattgccatcttcaagcacaaccagtgccttatcgttgactttgattccgtccaagacatttaaaaatgccttggtctttggagcatcaaagctcaagccatcaacaacgaccagatcgccatcgagaactttttgtgaaagtacggatttaatcgccaagcgccgaaccttcttaggcagcttgtaagcatagctgcgtggtgtcgggccaaagacgatcccaccgccgcgccattgtggactgcggattgaaccttggcgggcacgaccggtacccttttgacgccaaggcttacgaccgccgcctgaaacagcggaacggtttttaacggcgtgagtaccctgacgaagggaagcgcgttgcatcacaactgcgtcaaacacgacgttttcatttggttcgactgcccagattgcatcgttgagttcaaccgtgccgttttctgagccgtcttgcttatataaagtaacgttagccattagttattgtcctcccttcgtattatttagctgctttaacagcagaacggattgtaacaaaggacttgttagcacctgggacattgcctttgatcaacaggacattgtgttctgtatcggcggcaacgacttgcaggttttgcatggtgcgggtatggttacccatccggccaggaagcttcttacccttgaagactttgttgatgatagctccaagtgaacctggacgacgatggtagcgagaaccgtgtgccatagggccgcgggactgaccatctttcttgatattaccttgataaccatgacctttggaagtaccggtgacgtccacaatgtcgcctgctgcgaattcgtcagctttaacttcgctgccgacttcataatcactaagcgctacatcgcggatttcgcgaacgaagcgcttaggggtcgtgtcagcctttttggcgtgaccgacgcttggcttattcgtcaagacttcacgcatatcgccgtagcccaactgaactgcttcgtaaccatcagattcaacggtcttgacttgcattacaacgttgggtgttacgtcaattacagtaacgggaacaagttcgccgttatcggtgaagacctgcgtcatgccaacttttttgcctaagattcctttacgtgccatgggtacacctcctattttctaagaattataatttaatttcgatatcgacgccgcttggcaaatcgagcttcattaaagcatcaactgtcttcggtgttgggttaacaatatcaatcagacgtttgtgcgtccgcatttcgaattgttcacgtgaatccttgtacttatgtggggaacgtaaaaccgtgtaaattgtacgttccgttggcagagggatcggacctgaaattgttgcgcctgtacgctttgcagtgtcaacgatcttgtctgcggattgatcgagaatccggtgttcataagccttaagccggatccgaatcttttgttttgccattgtgtgacctccttcgtctattatcagttagtagactagctccgtgaaaattaccaactcgccaccgtggcaaagcggccgggcgtgtcgcaacctctcacatccacgctactctggttcatctctggaaccaagtgcatagttatcccctttgagaaacagcactcttgatagtatacaaaaactcccccgccattacaaggttttctttcgatttgcacaaaaaagtttgtgcgcttgatgctgagaaaagcaaacttgttttactgatcagctgtatgtgctacattcaaattaaatccagtattcgatttgattaaggagcatgccatgaaattcgatcactataaaaagtttatcaacgtagccttggatcttttgctcggtctgctcgctattgttgtcgtcatcttcatgttacgctacattatcgacattgggagtttaatccttcgaccgttatcggctgacctattcggcaaggtcattcaggaagtcacgagtttctttatgctgtttgaatttgtcattatgctgattcgctacattgaagaggggcaccatattccgattcgttatctcattctcatttcgatgacggccattttacggcagctgttggtcttacacgatcgtggtaccgaaaccttgcttttgacattggcaattctcgttttagcaggcgttttgacggtcttctcctttgttagtggcgatttcaaacactcgcgcggagaacaggatattgatatcgatcagcacttttgactgtggcgatcttgttttgccttagctactgatccaggctctgatgtattcttgttctttagctcgggttatatgacttcacgcaaaaaggaatcgcagctgaccgttgcgattcctttttgcgtgaatatatcctgaccggagcattcacaattagataattccctttaattaaagtttgccaaccaagtcagcacccggcttcaaggttttctcgccaggctgccagttcgctgggcaaacctgatcaccgtgagcggcaacaaattgtgctgcctgaagcgtccgcaaaatttcgtcagcgttacgaccgatgccgaagttgtttacgacataagcttgaatcacgccatcagggtcaataataaaggtgccgcggaacgcttgcccactcgcttcatcccgaacatccagcgccgttgccagtttaccagccggatcggcaagcatcggatactgaattttcttgatcgtcggactcgtctctgcccatgccatatgcacaaattcggtatcctcagaagcggaatagatttcggctcctgcagctttaaaacgatcgtagtgatcctgcaaatcgcctagttctgtgggacaaacaaatgaaaagtcagctgggtagaaacagattactgcccacttaccttgcaaatccttatttgtcaccgtgtgaaaatccccattttgataggcggtcaatgaaaagtccggtaaatgctgtccaataaagctcataatattccctccatttttagaatgattattatttacaacttaacggtaccttttcatgcccgcattttcaagcctaaattgccacgaattacctgtgacagttacacacataaatcaaaaatgttgctggttagcttgccttctttccaaaccgccgattaaaaaaacaccatctgtttcaatagacagtgtgtttaaaagtatgctcttaaggcgttatgtgaacttcctagcgcaaacggttcctttcttcatgccgataatgtgccaaaccttcttctaagccgcgaatgacataatcacgaatatactttggcgcaagcactttgactaaccctgcctgtcctagcaaccacatacgaatgccaaagccatcattaaccggaatggtgatgtggtagaacttttgcgcgtaaggattcttggacgttggctgctcatcgactttttcatcatgaacgatggcatccggaaagcggtcaaggacaaaacgcgggtcatagccatacaggatttccagattaattggcttgcctaagtatggataccatgtgtgtttttgtaaccggccgccgcgaaaacgtgcttcataggcatgttgcggttgacgtccatggtaagtaatatggctcatatcatcaagccgaaagcgcacaaactgaccattgtccggatcatcaggctgctcgtcactaccatcaataatgagataaaaaaataagtcaccaaaatataatccagttggtaggcgccgatcaaaatgacgggttacgccatgataagtatgatcgaagctaatggtctcatgtttcaaaatcgcctgactcaaacgtgccaaccgtgctgtgagtgctacttttggtacccctttatactcgaagatcggatttcgtaccacatcgcttaggcttcgatgctccggcccttcaggcagcaactggtgaagtagcattttcatctcggaagttgccaagccccgacttgcggtcaaaatcagcgtcattgctaataactgcccgtcatctaagggactgtggccagttgatagtacagttgacttgaagcgataatcacccgtggtactttcgacaaatacatccggctcgtccatcacgtcatcgaacatccgtttaatgacactaatatcacgccgaatggaagactcatctttattaaactcgtgcattaaggtttgtttgtttaatacctctcctcgcatgagtcgcagcataatcgttacaattcgttcctggcttgacacgttgcgccacttcctaacgtcacctaataataacagtatcatacgcgttcaaaaaacgtgccgtcaatcatctcaagaaaccttccaagctcatgatgtattgaacagcctagagatcggtcgaattcacattcactttccataacgcgttcgccggcgcagggatctgcgtgtaaggaccttgggcgcaatggtcaaagaccgaccatcacggttaaggccacttatgttctagctcatgcccataacgcgttcgccagcccagaaacctgcgtgtaaggaccttagccgcaatggccaaagcccggccatcacggctaaggccacttacactccggtttctaaccgggctggctcacgctcaataaaaaacggtgctgccttgaacaggcaacaccgtttttgtcgtcggtgatcacgaaagactagtctttcgtagcaacaccgccgccatttttcttgataatttcttcttggatgctctttggcacagcttcgtagtggtcaaaggtcatggtgaaagtaccacggccttgggttgcactacgcaaggtggttgcatagccaaacatttcggccagcggaaccattgagttaaccaattgcgcattaccgcgcgcttccataccttcaacgcgaccgcgacgtgctgtgatctggcccataacatcgccaaggtattcttcaggcgcaacgacttcaacgtgcatgatcggttcaaggatcacggcgccagcattcttcgaggcattacgtaacgccatggaagcagccactttaaaggcagcttcagaagaatcgacttcatggtaagaaccatcatatagtttggccttcacatcaattaatggatagccagccaagacaccgtttgccatggcttctttcagaccttgttcaacagctgggatatattcacgcggaacaaccccaccgacaatggcattttcaaattcaaagcccttgccttcttcgtttggtgtgaactcgatccaaacatcaccatattgacctttaccaccggactgacgaacaaacttaccttgtgcagacgcttctttagtaaaggtctcacgataggcaacttgtggttcaccaactttagcagccactttgaattcacgcttcagacgatcaaccatgatatccaagtgcaattcacccatgccggcaatcaatgtttcaccagtttcagggttggtttcagccttgaatgtcggatcttcttcagagagcttctgcaaaccgatatccagcttgtcttggtcttctttagagtcaggctcgatggaaacctggataaccggatccggaacatccaatgattcaagaatcaatgggtggttaacatccgtcaaagaatcccctgtggtggtattcttcaaaccgatagcagcagcgatatcgccggaaaagacttccggaatttcttcacggtgattactatgcatctgcaacagacggccgacacgttcacggttgtcttttgttgcgttcaacacataggaaccagcttccagtgtgccgctgtatacccgaatataggtcaaacggccaacaaatggatcagtcgcaactttgaaggccaaagcagcaaacggcttgtcatcaccagcggtcagctcaacggcatcgcctgtatcaggatcggttgcatgatacggacgaacatccaatggtgacggcaggtaatcaataaccgcgtccaacagcatctgaacacccttgttcttgaaagctgaaccagccaaaactgggtagaattccaagttaatggttgctttacgaatagcagcctttaattcagcattggaaatctcttcgccttcaagatacttgtccatgatgccatcgtcaacgtcagcaacggcttcgacaagttcgttgtgggctttttcggcagcttccttatattcatcaggaatgtcaaccgtatcccacttcgtcccgagttcatcttcgtcgtacaagtcggccttcatttcgatcaggtcaatgaccccttcgaacttatcttcggcaccgattggcaactgaacggcatgggcatttgcctgtagccgatcatgcaaagttgacaatgaatagtcaaaatccgcaccaatcttatccatcttgttaacgaaaactaaccgcggaaccccgtatgttgtcgcttgacgccaaacgttttcagtctgcggctcaacaccggattgggcatccaaaacggtgatcgcaccatctaacacacgcaaggaacgttcaacttcaatcgtgaagtcaacgtgtcccggggtgtcaatgatgttgacccggtgatccttccagaaagccgtggtagcagcactggtgatggtgatcccacgttcctgttcctgtggcatccagtccatctgtgaagctccttcatgagtttcaccgattttatgaattttaccggtataatacaaaatccgttcagtcgtggtcgttttaccggcatcgatgtgagccatgatcccgatattacgggtacggtctaacggaaattcacgtttgttggccatgtggcgtattgctcctctcttgattcaactggctttatacaaagaatggctactatataccaaaccgcggatataatagccaaaccatcttaccaacgataatgtgcaaatgcccggttagcatcagccatcttgtgggtatcttcacgcttcttcactgcggcgccggtgttgttagcggcgtccatgatttccttagccaagcgttcgtccattgtgtgttcaccgcgttgacgcgaatactgaacaatccaacgcaagcccaaggtggtccggcgatccggacgaacttcaatcggcacctggtagttagaaccaccgatacggcgagctttaacttccaagaccggcataacgttcttcattgcttcttcaaaaacgtctaacggttcgttcccggtttgtttcttaatcatatcaaatgcatcatataaaatagtggatgccttcccgcgcttaccatcaatcatcaagtggttgattaaacgggtaaccagctttgaattgtaaactggatcaggtaaaacatcacgttttgcgacactgcctttacgtggcatgcattttgcctcctcttaaaagtattcgtctgcccaagctgctcacaaaccggctcggctagcaacccaaagcgattcctgagtttcttttaggctgacgcatattctgtctataccgcacaaagcggatctaaaaatttgttgtcatcatcatgcggctaatccgcactgattttgcttacttcttcttaggacgttttgcaccgtacttcgagcgaccttgcatccggccgtcaacaccagcggtatcaagcgcaccacgaacgatgtgataacgaacccctggcaagtccttaacacggccgccacggatcaagacaacactatgttcttgcaagttatggccaatacccggaatataagctgtcacttcgatcaagttggacagacgaacacgagcatatttccgcaaagctgagttaggtttcttaggtgtcatggtaccgacacgagtagcaaccccacgtttttgcggtgctggattactggtaaggctcttcttcttgctgttgtaaccgaagttcaacgcaggagagtctgacttggttgatttggatttacgaccttggcgaactaattgattaatagtaggcattaagcttctccttccttatattgcatcttttttaagtccacacatccaggcggttcattttttgtgataaaaaaacggccaaccgaacggcgacggctcttaacccagtcagcacgtccggacaacccgaataaactggaaaaaagcacctttgatagtgtactatcctatacgcgctggtgtcaaggaaaacaatagaacattcacttgacatttgaaatggtgaacttttaacaaaagcgtatgaacgacaaccttttcacggttatatttctaaataaccggttaacttcaaccatagcaaaaaagttctgtaaagcaaccccgaaaggcagcttcacagaacttttttaaattcgggactttttgaaatctggcatatatattttttgatccactgcggccttttttctccagcgatttagcctgaaaagtttttaaaaatgcaggttttaagagaaatacatttgtcattttacttactttttgttacgaaagcgttgtcgatattgctaaatcgatcatattgcatcgttatcaagcgccatccatttttcagcgaaatttattctatgaagtgaggtggtggctttgattctagctttatttttactaaccgtgatcagcgtaacaaagcgtttaactagcattaatcagtcagttcattgtattttggcgattcttttagggataagcagtacgacctggttaccttttttcctcagtgtcggtttgcttatgtttagcattgctgattggcatgagcgcagcgtttcactcatcaatttttgtggctggtggtttggtatcattgtggtttttccctgcaatttgtttaatttaatgatgttaggttccatggttggcgggttagcactgatgtcgcacggtttaggcagtgctgatgttttactgattgcattattaggtggcgttctgcaactagaagctgccttggttatcacgttaattgcttgtatcagcgctggcggtcactggtttattacccgtttagagacgttgccgatgattagtcatatagcgatcggttacggttgctttagtttggcagctaattgcctaggcattttttgatcgtggtcatttgtgtacaagtcaaaacgtatgccttggcacagagattggtatgtaagcagctcgtgaccgttcctgctcgcgtgcatataaaaaagcggcgcaagtatctttttcaagatacttacgccgcttcttttgtggccagatgcttcagtttgaccaccgacaaggcgattactgtttgtcagtgtcgctttgctggttgtctttttccttcatctgtttttcgatgtctgaaatcgaataaacactgtcggaaaccgtaccgacactcttaggttcctcgtgacgataggtggccatcccggtaccagccggaatgatcttcccgataatgacattttctttcagaccaaccagtggatcgttcttgccgcgaatggatgcatcggttaagacacgcgtggtttcttggaaggaagcagctgataagaagctgttagtttccagagaagccttggtaatccccagcaagaccggacgacccgttgccgggatcccgccactgatgattgcttgcgtgttcttttccttgaagtccgcaatgtcgagcaaggtgcctggcagaatattcgtgtcgcccggatccatgacgcggatcttacgtaacatttgccgtaccattacttcgacgtgcttatcaccgatgtcaaccccttgcatacggtaaactttctgaacttcagaaagcaggtagttttcggttgccatcacatcgcgcaccttgatcaattgcttaggatcaattgaaccaccagttaagcgttcgccacggttaatgtgatccccttctgcaacggccacactagatgcatatggcacactgtaagtccgggtatcggtttcacctttgacggtaatttcacgcgtatgctcggctgggttttcatcaattgccgttacttcaccagtaacttcagtgataaccgcttcacctttaggattccgtgcttcaaagatttcctgaacacgaggcagcccttgcgtgatatcttcgccaccagcaacaccaccggtatggaagttacgcatggtcagctgggtacctggttcaccgattgactgtgccgccacggtcccgacagcttcaccgacttcaacctgttcgccggttgccatgttacggccatagcacttctggcaaacaccatgcttcgtgttgcaggtaaagaccgaacgaatggtaacggcttcaacgccagcatccacaatcttctgagccatgtcttcatccataagcgtattgcgtttaaccagcacatcgccagtctttggatcaagaacgtctttcatcgtgaaccggccaaccaaacgatcatacagcggttcaatcatttcgttaccttcacgaattgcacgaacaaccaatccacgatcagtaccgcagtcttcttcgcgaacaatgacgtcttgggcaacatcaactaaacgacgggtcaggtagcctgagtcagccgtcttcagcgccgtatcggtcatccctttacgtgcaccgtgagttgacatgaacatttccataacggttagaccttcacggaagttcgagataacaggaacttccatcatccctccgttaggcgcagccatcagaccacgcataccggcaagctgagtaaagtttgagatgttaccacgagcaccggaatcagacatcatggaaattgggttgttcgggtcaaaagaatcaaccagtttttgctggatttcatctttagcgtcgttccagatctgaatgacccggtcatgccgttcatcgtcagtgattaaaccacgacggaactgcttagaaaccgttgcaaccttcttatgggctgccgccacaatctctggcttttccttcaggttcgtaatgtcggcaatcccaacggtcaaacctgaattcgttgactgagtatagccgagtgtcttcatgtcatccagcaagtcactggtccgctgaactttataaactttgaagacttgggcaatgatgtcagacaggaatcctttcttgaatggatcgatcaaaggtgcatcttcaaggtaagcatggatatcttcacctttgtcgatgaagtatttgtccggcacaccattgacgatgttgtcctgagtcggttcgttcaaatacgggaagtcttttggcatgatctcgttaaagattgccttgccgacactcgtcaccataatcttttgtttctgctcatcagtaaacggtttgtccgtaaaggagttcgcagcaatcccgacacgactgtgcagatgaacatagccattttgcaacgccatcaacacttcattggtatccttgaagatcatgccttcgccttcgcggcccttctgctccatggtcaggtagtagttacctaacacaacgtcttgagaaggggtaacgattggcttgccgtctttaggtgccaaaatgtggtgggctgccagcatcagcatgcgcgcttctgccattgcttcatcagacagcggtacgtgaatcgccatctggtcaccatcaaagtcagcgttataagcttcgcaaaccagtgggtgcaagcgaatggacttaccatcaaccaagacaggttcaaatgcctgaatacccagtcgatgcaaagtaggcgcacggttcaaaaggactggccgttccttaatcacatcttcgaggacatcccagacatcatcgtcttggcgatcaatcttccggcgagcatttttaatattgcttgccatatcgcgcttaaccagttcgcgcatgacaaatggcttaaagagttccaaggccatttcacgcggaacaccacactgataaaacttcaaccatgggccaacatcaataaccgaacggccagagtaatcgacacgcttacctaacaggttttgacggaatcggccttgcttccctttcaacatgtgggacaaggacttaagcgggcggttaccaggtccggtaaccgggcgtccgcgccgaccgttatcgatcaaggcatcgaccgcttcctgcagcatgcgcttttcgttttgcacgataatacttggtgcattgagatcaagcagacgcttcagacggttgttacggttgatgacccggcgatacaagtcgtttagatcagaggtcgcaaaccggccgccttcaagctgaaccattggccgcaaatccggtggaataacaggaatcgtgtccataaccatccatgccgggtcattaccggactccttgaacgcatccaaaatgtccagacggcgaatcgcacgggtccgtttttgaccctgagctgatttcaggtcttcttttaattcagcaacttctttttcgagatcaacatcctgcaacaattccttgatggcttcagcacccatcttggcattgaaggtctgtccatattcttcccgcttttcgcgatattcgcgttcggttagcagctgctttttctccattggcgtatcgcctggatcaatcacaacataggaagcaaaatagatgatttcttcaagtgaacgcggcgacatgtcgagtaccagacccatccggctaggaattcccttgaagtaccagatgtgcgtcaccggtgcagctaattcaatatgacccatccgttcgcgccgaaccttggaccgggtgacttcaacgccgcagcgatcacaaacgattcccttatagcggattcgcttgtacttaccacaggcacattcccagtctttggtcggtccgaagatacgttcatcgaataagccgtcccgctcaggctttagggtccgatagttgatcgtttcgggctttttgacttccccataagaccagctgcggatcttgtccggcgaggctaagccgatttgcatactttcaaacttattgacatcaatcaaagggctaacctcctatttcttatcgtcggtactattgtcggcagactgaccgtcacttgcttgggttgcggcttcgtgtgccttcttttcttcttgctgagctgcgaacttcgctaatgcatcgacggaaacaacatcgtcttcgtcatcgtccatgtcgcgcaattcgatttcctgcttatcagcacctagaaccttcatatcaagtcccagcgcttgcaattccttgaccagcacacggaatgattccggtacgccaggctttggaatcggatcgcccttaacgatggcttcgtaggtcttaactcggccaacaacgtcatcggacttataagtcaagatttcctgtaaggtatacgctgcaccataagcttcaagggcccagacttccatttcaccaaaccgctggccgccaaactgagctttaccaccaagaggctgttgggtgactaaactgtaaggtccaattgaacgcgcatggatcttatcatcaaccatgtgagacagcttcatgtaatacatgacaccgacagatacccggttttcaaatggttccccggtacggccatcatacaagactgacttcccatcagatggcatgccggcttctttaacggttgcccacaagtctttatcgttggcaccgtcaaagactggcgttgcaacatgaatgcctaagttacgagcagccatgcccagatgcaattccagcacctgcccgatgttcatacgacttggcacacccattggcgacaagcaaatatcgactggggtaccatctggcaagtatggcatgtcttcttcaggcacaacgacggaaaccgtccctttgttcccatgacgaccagccatcttgtcaccaacttgaattttccgcttctgcgtgatataaacccgcaccatcatattgacgccaggagataattcatccccagcttcacgggtgaagattttgacgtcctgaataataccgccgccaccatgcggaacccgcagcgatgtgtcgcgaacttcacgtgctttttcaccaaaaattgcgtgtagcagccgttcttcagcagataattcggtaactcccttaggcgtcactttaccgaccagaatgtcgccatcccgaacttcggcaccgacacgaacaaccccgaattcatcgagatccttgagggcctcttcaccaacgtttggaatctcacgtgtgacttcttcaggtccaagtttggtgtcacgtgcttctgactcatattcttcaatatggatcgacgtgtaaacatcatctttaaccaaccgttcagacagcacaatcgcatcttcgtagttgtacatgttccatgtcatgaaggcgatgatcgggttttggcccaatgccaattcaccattttgcatggctggtccatcagcaatgatttcatcgacatcgacatggtcaccgatcgtaacaatcggacgttggttgtagttcttgccggcgttactacgcttgaatttcatcaatttgtaagtgtccaaggcgccgtcttcacgacgtacccggatttgcttagcatcgacatattcaaccgtaccggcattgttagccaaaaccgcggttcctgagtcatgggcggctttgtattccatcccggtcccgacaagcggggcatgcggattgatcaaaggtaccgcctgacgctgcatgttagcacccatcaacgcacggttagagtcgtcgttttccaagaatggaatgcaggcagttgcgactgcgacaacctgcttaggcgaaacgtccatgtaatcgactttgtctggtgaaatttcaatgttgttatctttatgccgggccaaaaccgtgtcatcaacgaaggatccatcatcgtttagtggcgagtttgcctgcgcaacaatgtagttatcttcttcgtcagctgtcaggtaatcgatcttgtcggtaaccttatgcgtatcccatgaaacccgtcgatatggcgtttcaatgaagccgtatgggttaacgaccgcgtatgaagccaagctgttaatcagcccgatgttcgggccttcgggggtttcaatcggacacatccggccataatgggtgtaatgaacatctcgaacttcataacccgcacgatcacgagtcaagccaccaggtccaagggcagacagacgccgtttatgggttaattcgcccaacggattggtctgatccatgaactgtgacagctgggaactgccaaagaattccttaattgaagccacaactggccgaatattgatcaattgctgcggtgtaacggttgcggtgtcctgaatcgacatccgttcgcgaacaacccgttccatccgcgaaagcccgatccggaactgattttgcaataattcaccaacggaacgaatacgacgattacccaagtggtcaatatcatcaaccgtacctaagccttcctgcaagttcaggaagtagttcatcgatgccaaaacgtcagctggcaaaatatgcttaactttcttgccgatatgcccattgccaattaaattaatttctttatccggggtcacctgtgagtaaactttaatactctgcagctcaatcggatcggtcatcacaccttgatcagaaggttgataagtggccgtcttgaaatcatcccgatccaagtacggtgccagcttatccatcacttggcgatccactttggtccctttttgggcaacgacttcacctgtatccggatcagccagtgtttccgctaaaacctgattcaatagccgggtcttcaggctcagcttcttgttcaccttgtaacgcccaacagaggctaagtcataacgcttcgggtcaaagaagcgggcatacaaaagtgaccgcgatgaatcagcagtcttaggttcgcctggacgtagacgttcataaatatccttcaaggcttcatcagtacgggaatcatccgtatttttatgcacatctttttcaagtgtgagcatcaacgaatcattgtccccgaacatattgataatgtcttgatcggagccaaagcccaatgcgcgaaccaattcggtcagaggaatcttccgcgtgcgatcaatccggacatacgcaatgtccttcgcatcggtttcatattccaaccatgccccacggttaggaatgacagtcgtgccatacgtcacccgtgagttcttatctgtttcactatggaagtaaacgccaggggaacgaaccagctgggaaacgataacccgttctgccccgttgataatgaacgttccttgtttcgtcattaatgggaaatcaccaaaaaagacgtcctggctcttgatttcgccagtttcatgattcgtcaaacgtaaggttacatgcaatggtgcggagtagttcgcatcgtgttggcgtgcttcctcgacagtatatttcggttccagcagttgatagccgacaaattccagtgacagtttcccctgaaagtcatcgatcggcataatatcgtcgaacatttctttaagaccttcatcgaggaaccattggtaagaattcgtttggatctcgatcagattaggaagatccaaaacttccttgatccgggcataagaccggcgtgtccggtgcttaccataattcactaagtgtcctgccaaattattcaccccttgtaagattttccggcttgatgattgtaaaaataatgtaaatattgttaaatttacatgacattgaccatcccgcagacattttgagcaaaaaaaaaccaaaaacagatcgaccttcaaccagcctgctgtttttgcttttttcattagtcagaacggacaatagatcgtcctgacagcctgtccaaaccgaaatgcgattggtttaataatacgcgtgcggagtaacaatgtcaagcacctgcttttcaaagtaatgcaataccagatagcatcaaaatcgcgtcccgccatcactgactgttttggcaaaataaatcggtcccagagataatgcttcacctctaagaccgatctttttaagcgttattagtggaacctgacatatttgggcctgctattgatcatgccttgacaggttctttagaagcgccattttctttatgcttatctttgttttccttgactgtaaacgtcagcttgccttttttagcgccgatttgaatcaagtcgccggttttagcctgacccgtcaacaatagctcactgagttggtcttcaacatccgtttgcaaggcacggcggatcgggcgcgcaccatattcaggatcaaatccagccgcggcaatcgcatcaatcccggctggcgtaattttaacgtcaattccttgatctttgatacgactaagcacggttttggtcataatcttgacgatctcatgcaactcagccttgttcaagctatggaagacaacggtttcgtcaattcgattaaggaattctggacggaagctctttttcagttcagccaacatccgactcttcatggcattgaagtcagcggttggatcttttgcaccaaatccaactgtcttatcatcgcgaatggcagttgctccgatattgctggtcataatcaaaatggtattccgaaaatcgacccgccgacccttagcatcagttaaatagccatcgtccaagacttgtaacaaaatgttgaagacatcaggatgcgccttttcgacttcatcgagtaaaacgaccgaatatggcttgttgcgaaccttttccgtcaactgaccgccttcgtcataaccgacatagcctggtgctgcaccgattaaccggctcgtactgaatttctccatatactcggacatatcgacccgaatcatggcgtcctcggaaccaaacatcgcttctgccaacgctttagctaattcggttttcccgacgccggttggtcccaagaacatgaaggagccaatcggtctggtcggatccttcaacccggaacgagcacgccgaattgcccgtgcaactgctgaaacggcttcatcctggccaacaactcgctgatgcagaatcttctcgagattaaccaaccgttcggattcctttttctgcagttgcgtgaccggtacgccggtccattgcgatacaacttcggcaacgtctgcgcccgtgaccttgatatcggtacgaacaccactttcattcaccggttcaggcgtatcggcaagtttagccttgacgcccgcttctttagtccggattgtagcagccgtttcgaagtcttgatgatcaattgcatcttctttgtcggcaaccagtttagctaattcatcctgaagtttatcagctttggtctccacgttagctttatcaaggcgaactttagccgcactttcatcgaccaagtcaatagccttatccggaagaaaacgcgttgtaatgtaacgtgacgacaacacaaccgcttcatgcagcgcttcatcagtaatcgtaacgccatggtgtgcttcgtaacgcggacgcaagcctttcagaatctgttcggcttcttcctcagtcggttcgtcaacttgaattgttgcaaaccgccgctccaaggccgcatctttttcaatgtacttttgatattcgtctaaagtcgtggcgccgattagctgaagctcgccacgtgccaatgccggtttcagaatatttgaagcgtcaatcgccccttcagcaccgccagcaccgatcaatgtatgcaattcatcaatgaataaaatgacattgccatctttataaatctcatcaataattttcttcagccgatcctcaaactcaccacgatacttagtgcctgcaaccaacgaacccatgtcaagcatcatcaagcgtttgttcagcatatcatccggcacttttccagccacaatcttttcagcgaagccttctgcaatggccgttttgccgacaccgggttcaccaatcaagaccgggttgttcttagtgcgccgcgccaagatttgaatcaagcgccgaacttctttgtcgcgaccaaccaccggatccatccgattttcgcgcgccatctgggttagatcacgggcgaggccatcaagcgttggtgtcccctgaccgtcttggcgagcgccgccacgtgccattggccgccgctttgccgccgtatccgcgatgcccattttcttgaagaccatctgacgcgtcttcgagagactgagccctaagttttgtaaaatccgcgcagctaaaatatcgtcttctcgcaatagtcccagcagaatatgctcggtgccgatttttaacgcccctaagcgttttgcttcgtccccggcaaatgccagaatttccttgccttttggtgagtatggcaaataactatcgctagcttgactggcggcatcaacagttccatatcctgtgaagcgctcgatctcgtcatggacatcattttctgtgacccctaactgacgcagcgtcttaccagcgataccatccttttccataaccaaagccataagcaagtgttccgtgccaacagcatgatgatggaagtacttcgcttgttcctgggctaaaagcaacacatttttagcactaggggtaaataagttgtccataagcacgctccttttttaaaaagccaattataaactgttttatctttcataccgcaaacgatccaaaaatgcaagaaacaaacgcgatcgtaagtgttcttctgtttcttgatcaagaattcccaaagtctcatgattgatcacggctagcattaaattgccggactgttgggaaataagcccattatcaaacagttcctgaagcaaatcccgtgcatcgcgtaaccgcaagcgactaggaatgtgctggcgcatgatttgaatgagatcctgatcatctgtcaatttgaccttcacgatccgaatgtagccaccgccgccacgcttactttcaacaatgtacccacgtgccggtgtaaaacgcgttttgataacataattaatttgcgaaggaacacaattaaagcgccgtgcaatttccgctcgccgaatctcaacagccgcttcctgtgccagtatcgtttttaagtatgtctcaataatatccgaaatattttcgcgctgcatgccattcaatcctttttgactttgaccaatcttgactattacacattatactggcatcaatgtatttatacaaatatatgctttgaggtaaacgaaaacagtgccggttagaattcagaatgtgagtggctgtacacgttataggcgctgagtttacggtcacctacacgcaggcagccaccatgaccaatgttttttggagaacgaaaaaaggaccacgattgtcgtgatccaagaatcgggaagacaagattcgaacttgcgacccctacgtcccgaacgtagtgctctaccaagctgagctacttcccggtaaagcggaagacgggattcgaacccgcgacccccaccatggcaaggtgatgttctaccactgaactacttccgcataccgaatatgaaatttgatcagcgccacagcttcatagcgaccaatgatgcacccagtaggagtcgaacctacaaccttctgattcgtagtcagacactctatccaattgcgctatgggtgcttcaacaaaatgccgaggaccgggatcgaaccggtacggtcatcactgaccgcaggattttaagtcctgtgcgtctgccaattccgccaccccggcataaagtgaaaagcggaagacgggattcgaacccgcgacccccaccatggcaaggtgatgttctaccactgaactacttccgcatatcaaagctattcaattgtgaccgaggagcagcctttaaaacccgagcaaatcatgtaagatacaatgcgggtgaagggactcgaacccccacggtcaaaaaccactagaacctaaatctagcgcgtctgccagttccgccacacccgcaaaaggtgggttaaatgagccgtgacaggctcgaactgtcgacccactgattaaaagtcagttgctctaccaactgagctaacggctcaatggaggatacagggctcgaacctgtgaccctctgcttgtaaggcagacgctctcccaactgagctaatcctccatatgtaagcgtggcagcttcctaccctcgcaggcagtttcccaccaactactctcggcgtgaagaagcttaacttctgtgttcggcatgggaacaggtgtatccttcttgctatcgccaccacacttatgagaactttgcgctctcaaaactggctatcattgttgttggtttgcattgccggaacttaacgtatttcatcgaaacgcgcgcgctggcttagcgccagtttgcgctttacttggttaagtcctcgaccgattagtactggtccgctccatgcatcgctgcacttccacttccagcctatctacctgatcatctttcaggggtcttacttccatataggaatgggaaatctcatctcgaggggggcttcacacttagatgctttcagcgtttatcccttccgttcatagctacccagcgatgcgcctggcggcacaactggtacaccagcggaacgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccagggtagcttttatccgttgagcgatggcccttccatacggaaccaccggatcactaagcccgactttcgtccctgctcgacttgtcagtctcgcagtcaagctcccttctacctttacactctgcgaatgatttccaaccattctgagggaacctttgggcgcctccgttacattttaggaggcgaccgccccagtcaaactgcctacctgacactgtctcccgccacgattagtggcgcgggttagagtgttcatacagctagggtagtatcccaccaatgcctccatcgaaactagcgttccgatctctacggctcctacctatcctgtacaagcggtaccaacactcaatatcaagctagagtaaagctccatggggtctttccgtcctgtcgcgggtaacccgcatcttcacgggtactataatttcaccgagtctctcgttgagacagtgcccaaatcattacgcctttcgtgcgggtcggaacttacccgacaaggaatttcgctaccttaggaccgttatagttacggccgccgtttactggggcttcaattctgggcttcgcttgcgctaactcatcctcttaaccttccagcaccgggcaggcgtcagcccctatacatcatcttacgatttagcagagacctgtgtttttgataaacagttgtttgggcctattcactgcggctgaccttgcggtcagcaccccttcttccgaagttacggggtcattttgccgagttccttaacgagagttcgctcgctcacctgaggatactctcctcgactacctgtgtcggtttgcggtacgggtagtttatttctcactagaagcttttcttggcagtgtgacatcaggaacttcgctactttaatttcgctccccatcacagcttgtccttaaggcggcaagcatttcactcgctaccggacttactgcttggacgcacttttccagccgtgcgctttccttagcctcctgcgtccctccatcgcttaaacaaaataaactagtgcaggaatctcaacctgcttgtcatcgactacgccttgcggcctcgccttagatcccgactaaccctgggaggacgagccttccccaggaaaccttagtcatacggtggatcagattctcactgatctttcgctactcatgccggcattctcacttctaagcgctccagccgtcctcacgatcgaccttcaacgcccttagaacgctctcctaccgcgcaccctgacgggtgcacccacagtttcggtattatgcttagccccggtatattttcggcgcagtgccactcgactagtgagctattacgcactctttaaatggtggctgcttctgagccaacatcctagttgtctgtgcaacgccacatccttttccacttagcataaatttagggaccttaactggtgatctgggctgttcccctttcgacaatggaccttatcgctcactgtctgactcccggagtaagatcaatggtattcggagtttatctgaattcagtaacccttgacgggcccctagttcaaacagtgctctacctccatgatccatcctccgaggctaaccctaaagctatttcggagagaaccagctatctccaagttcgtttggaatttcaccgctacccacaactcatcccagcatttttcaacatacatgggttcggtcctccagtgtgtttcaccacaccttcaacctggtcatgggtaggtcacttggtttcgggtctacatctacctactgaagcgccctgttcagactcgctttcgctccggctccgacttttcatcttaacctcgcaggcaaacgtaactcgccggttcattctacaaaaggcacgccattacccgttaacgggctttgactaattgtaggcacacggtttcaggaactgtttcactccccttccggggtgcttttcacctttccctcacggtactggttcactatcggtcactagggagtatttagccttgggagatggtcctcccggattccgacggaatttcacgtgttccgccgtactcaggatcctggacggagagtccgccgtttcgtttacagggctttcaccttctatggcgcagctttccagctgacttcgactacgtcgaactttggtaactccaatgtccagtcctacaaccccgagaagcaagcttctcggtttgggctcttcccacttcgctcgccgctactatgggaatcgagttttctttctcttcctgcgggtactgagatgtttcagttccccgcgtctgccgccaacaagctatgtattcacttgcaggcaatacactgatgtgtactgggttcccccattcggaaatctccggatcaaagcttacttatagctccccgaagcatatcggtattagttccgtccttcatcggctcctagtgccaaggcatccaccgtgcgccctttgtaacttaacctgtactgacttgcgtcagcggttatgcgatgcgaatttctattattagaaactcatacaaatacgctgtgttctcggcaatttaaaacatttacaacaatgatatccagttttcaaagaacaaagtcgtacccgctagggtgcttgagggtaatcccctcaaaactaaacaaagtttcgtgtgtgcaggtttccgtcagactttcagtctgtttccttagaaaggaggtgatccagccgcaggttctcctacggctaccttgttacgacttcaccctaatcatttgtcccaccttagacggctcgctccctaaaagggttacgccaccggcttcgggtgttacaaactctcatggtgtgacgggcggtgtgtacaaggcccgggaacgtattcaccgcggcgtgctgatccgcgattactagcgattccgacttcgtgtaggcgagttgcagcctacagtccgaactgagaatggctttaagagattagcttgacctcgcggtctcgcaactcgttgtaccatccattgtagcacgtgtgtagcccaggtcataaggggcatgatgatttgacgtcatccccaccttcctccggtttgtcaccggcagtcttactagagtgcccaactaaatgctggcaactagtcataagggttgcgctcgttgcgggacttaacccaacatctcacgacacgagctgacgacaaccatgcaccacctgtcattttgcccccgaaggggaaacctgatctctcaggtgatcaaaagatgtcaagacctggtaaggttcttcgcgttgcttcgaattaaaccacatgctccaccgcttgtgcgggcccccgtcaattcctttgagtttcaaccttgcggtcgtactccccaggcggaatgcttaatgcgttagctgcggcactgaagggcggaaaccctccaacacctagcattcatcgtttacggcatggactaccagggtatctaatcctgttcgctacccatgctttcgagcctcagcgtcagttacagaccagacagccgccttcgccactggtgttcttccatatatctacgcatttcaccgctacacatggagttccactgtcctcttctgcactcaagtttcccagtttccgatgcacttcctcggttaagccgagggctttcacatcagacttaaaaaaccgcctgcgctcgctttacgcccaataaatccggataacgcttgccacctacgtattaccgcggctgctggcacgtagttagccgtggctttctggttggataccgtcacgccgacaacagttactctgccgaccattcttctccaacaacagagttttacgacccgaaagccttcttcactcacgcggcgttgctccatcagacttgcgtccattgtggaagattccctactgctgcctcccgtaggagtttgggccgtgtctcagtcccaatgtggccgatcaacctctcagttcggctacgtatcattgccttggtgagccgttacctcaccaactagctaatacgccgcgggtccatccaaaagcgatagcttacgccatctttcagccaagaaccatgcggttcttggatttatgcggtattagcatctgtttccaaatgttatcccccacttaagggcaggttacccacgtgttactcacccgtccgccactcgttcaaaattaaatcaagatgcaagcacctttcaataatcagaactcgttcgacttgcatgtattaggcacgccgccagcgttcatcctgagccaggatcaaactctcatataaatatgagctgttcgaatagctcgatttgttgttctagcgaattgacttcgcaaatgttactttttgcctcgataccgaagtatcaaggaccctgcacatttaaacgaaactttgttcagttttcaaaggactaccttgtcaaaagacaactttgatatattatcacaagcgatcaacgcttgtcaataactttttttgatgttttgttgcacatcagcgttgctcatttacgacgctttttatcataccaacggtttgcgctatcgtcaacaactttttcaattaaaaaaaggtatccggatattttttatcgaataccttatatcattcgtaaaatgatcgtgagagcaccacaaaagtgttggaactttcggaaaataaaaatgccgcctaaaatggcgacattatcacataactacgggcgcaatgttgggaacaaaagaacatcgcgaattgacggtgcatcggttaacagcataactaagcgatcgataccgattccgagtccacctgttggcggcatgccatattccaacgcttcaacataatcgtcatcaatgccttgtgcctcttcattgcctgccgttttttcagctgcttgcgcttcaaaacgctgacgctgatcaatcggatcgtttaattcggtgaaggcattggcgtactcaccgccaccgacaaaaagttcaaaacgctcaacaaatcgtggatcttttggatttttcttagctaacggggaaacttcgattggatggccggtaatgaaggtcggttgaataagcgttgattcaacaaactgatcaaagaaggcactgataatatgaccaaccttccaataaggttcgtagtgaacttcatggtcatcagctaacttacgcgcttcatctacactcatttccggccagaagtcaacgccggttttatccttgatagcgtctaacatgttgatacgggcaaatggtgcatctaagtcaatgtccatcccttgataagttagcttcccggaatcaaggactttgtgggcggcaaatctaaagatgccctcggtttcgaccatgacatcggatagatcccaataagcggcgtaggtttcaagctccgtaaactccggattatgtttcgtgtcgatgccttcgttacggaaaacgcggccgatttcataaacgcgctccatgccaccaacaatcaaccgcttcaagtgcaattccaatgcaatgcgcaaataaaggtcgatatccaacgcattatggtgtgtgataaatggccgcgcattcgcaccaccggcctgattatgcaaaaccggggtctcgacttcaagaaatccatggttatccaagtattcgcgaacagcactcacgattttggtgcgtttaacaaaccgatcaaaactgtcaggattcgaaataaggtccaaatatcgcttgcggtacttctgctcgacatcggttaagccatgccacttatccggcaatgggcgtaatgctttggctagatgcgtcacgtgattggctttgacggtcagctcgcccgagtcggttttcatgacttcgccgctgatacccaaaatatcgcccaaatctgccttcttaaagatcatgtagttttcatcgccaaccacgtctttacgaacatagatctgcattttaccgctgcgatcacggatgtcagcgaacccgactttacctttaccgcgtttggacatcatgcgtccagcaatcgtcacttccggcttttcttcaagtagcgtttctttgtcgtcttcgccaaattcttcacgtacctttgctgcagagtgcgtgcggtcaaaccggtgaccgaatggatcaattcctgcttctcgcaaggcgtccatcttttcccgccgcgcaatcatttgatcgttcatttctggttgctgtccgttatccttagccaacacaagttcctccgtttcaatttataccactctttgatgatgacaattttaccgctaaaaagcaaccttctacgcattaaaagacgttcgccatgatttattgtcaatcaatcatccttgaacgccttttatcatcaaaggttttatggcttaatggctgccttgacgctgacgggcgcgcgcttcagtttgcgccacaaagtcatcaaaaatatgattgacttctgcttgcgtatcaaccatattaacggctgctttggtctttgccgagcgaggaatgccttttaaataataggctgcttgcatccggaattcacgaacggcctggtgttctccgtgcaggtcaaccaaccgttgtaactgcaacttggcagtggcgattttttcgcgcggtgttggttccggaatcagctccccatgatcaagataagctgccatctgcttcaagacccacggatttcctaatgctgcgcggcccaccatgactgcatcggcgccaacctcatcaagcatccgtttggcatcttgtggggttcgcacgtcaccattcccgataaatggaatgctcaggtgttgtttaacttcttttaagatgttccagtcagcatgtccggaatatagctgcttgcgtgtccgcccatgcatggctaatgcggcagcgccaccgcgttcagctgccaatgcattttgaaccgcataaatgtggtcttcatcccaacccgtgcgcatcttaaccgtgaccggctttgaaacggcatcggtcaccgccgccaccatttcgtaaactttctccgggtctaaaagccagtgtgcccccgcatcggtcttggtaactttaggtacagggcaacccatattgatgtcaatgatgtctgcagccgtgttttgatcgacaaacttagctgcattcaccaacgtttccttggtgccaccgaaaatctgaatggaaatcggatgttcacgcggatcaacaaacagcatacttaacgtctttttatttttgtacataatgccgcggtcgctaatcatttcacaaacgaccaaaccagcaccgaattccttggctgtcacccgaaaagccgcattcgtcacaccagccatgggtgcaacaacgagtcggtttgggatctcaacatcggcaatgtgccacatacaagccacctctttcttgctttcgcgttgttaactttacttaaaataagcaaacactgcaactattcatgccgggccaacaaagcttcaagatcggccacactgtaatgatattgattaccgcagaacttacaggtcgtctcggcaccgccgtcttcatcaatcatttcctgcaattgtttccgcggcaaagtggccataatatcgccaaaatgtttcttggaacaattacatgcaaaccgtactgcttgggtatccaggaagcgaacgggctctttgcctgcaacgcgttggataatctgctcgggagtcaagccacttttcaataactctgatacaagcggtagtgttttgacgtttgcttccagttctgacaattcggcatcggtcgcaccgggcaacgcctgtagcatgaaaccgccagcaactttaatcgtgttatccgcattgacaaatacagagagtccgactgccgcgggaatctgctcagacttagctaaataatacgtaaaatcttctgctagctcacctgaaaccagtggtacctgtcccgtaaacggctcgccgattccgatatctttcgtcaccgcaagcatgccgtgtttgccgactgcttttgccacatcgattttaccgacgagattgaggggaagattcacgtgcggttcctgaacatacccgcgaacggttccgagttgcgtaccatctgtgacgatcgagccaaccgggccatcccctttgatacgcacagtcagcaagtcattcgtgttttttaatcccgatgcggctaataacgctgtggcaattaaagttctgcccagcgcagccgaagccgcactccaggtgtcatggcgtcgttgtgcttcgcttaccgtttgcgtggcgtcaactgcgaaaattcgaaaatgggcgttgcgcgacaatgcactcgcgatgtagtcactcatgttggattgatcctcttttctgaaagttaaacgtggctattctaccaaaaattgccgttattgaaaagccggcgcagaaacccacatgtcaaagctttggttgcgatggtcaaagtccgatcatcacgtttaagaccacttgtgttctggcttatgcccataacgcgctcaccggcgcagaagtctgcgtgtaaggaccttaaacgcaatggccaagtccgggccatcaggtttaaggccgcttgtgttctggtttatgcccataacgcgctcaccggcgcagaaatctgcgtgtaaggaccttaaacgcaatggccaagtccgggccatcaggtttaaggccgcttgtgttctggtttatgcccataacgcgctcaccggcgcagaagtctgcgtgtaaggaccttaaacgcaatggccaagtccgggccatcaggtttaaggccgcttgtgttctggtttatgcccataacgcgctcaccggcgcagaagtctgcgtgtaaggaccttaaacgcaatggccaagtccgggccatcaggtttaaggccgcttgtgttctggtttatgcccataacgcgctcaccggcgcagggatctgcgtgtaagggcctcgaacgcaatggccaagcccgggccattgtgttcgaggccacttacacttcgatccctaaacgcgccggttcgcgcttaacaaaaaaacaccaccaacatttggcagtgtttttatacttaggcttgcggattctgatgatcgtcatcggacgggttactgccaggtgttgtgtcgtctggcttttccacactgtccgtcgtattgtcatcatgcgcatcttggtctgtttgatcagcattcgtctgaccctcagacttagcatgtgcttcttcgtctgcttgcttttctttatccttgtgttccaaggctgctttggattgctcaaaagttgcggccttttcgcttggaaattcgtcttgatcgcgttctggcatcttgccgtcattgaacaagctgagaatttctttttcattcaaggtttcgtacttaagcagggcttcggcaattaacttatgctgatcgcgatgggcctggataatttcgtaggcctgtttgtgggcttcgtcaataatccgccgcacttcatcatcaattgccgttgcggttgtttctgagtatggcggtgtttgcccatactgagcacccaagaatggttgtccttcagtctcaagctgaacggttccaagccgatcagacatcccatactgtgtgaccatgctgcgcgcaatttgtgttgcctgctcgaagtcgttggacgcgccagtggattcaacgccgaaaataatttcttcagctgtgcgaccaccaagcaaaccaacaatttgttctgtcaattccttcttggttagcaggaactgatcatcttttggcagcataatcgcatacccgcctgcacgaccacgcggaatgatggtgactttgcgtaccgtccgcgaatcgcttaagactaagccgacaatggcgtgaccagcctcgtgatacgcaaccatcgtccgttctttcggactgatgacgcggtctttcttcgctggcccggcaatgacacgatcttcggcttcatccacatcggctgcatcaatttgcttcttacttcgtcgtgctgcaaccaacgccgcttcattcagcagattttccaagtcagccccgacaaaaccaggagtctgacgtgcaatttccttcaaatcgacatttggtgccagcggtttgttctttgcatgaaccttcaaaatggcttcacggcctttaacatctggtcggccaaccaaaatcttccggtcaaaacgacctggacgcagcaaagccggatcaagaacatcggaacggttcgtggcagcaatgacaatcacgccttcattacccgtgaacccatccatttcaaccagcaactggtttaatgtctgttcacgttcatcgtgaccgccgcccataccggcgccacgctgacgaccaaccgcatcaatttcatcaatgaagatgatcgaaggagctgcttttttagcctgatcaaaaagatcacgaacacgcgaagccccgacaccaacgaacatctcgacaaagtcagaaccggaaatcgagaagaacggtacgccggcttcaccagcaaccgccttggctagtaaggttttaccagtaccaggaggaccctcaagcaaaaccccggctggaatacgggcacccaatgccgagaatttacgcggatctttcaggaactcaaccacttcaaccagttcctgcttttcttcttctgcaccggcaacatcagagaagcgaactttattggcatttttatcggcttgtttagcccgcgacttgccaaaactcatcacgcgaccggagccgccgccttggcctgcctgattcatcatcatatagaagaagatcatcatgatgacaatcggtacaactgtaatcaacaagctaaaccaaacaccggactgcgattcctcctgcgtattggtcttgacattgttggcattggtcattttttggatctgactcaaagttgcatcattcgtcggaatataagtcgagaatttggtaactttggttgactgattgccaaaaaagctcagagagttgttcgtaccggaagacttttcggccttcttgtattcaccgctgaccttataaacgccaccagatggctggagcgaataacttttgacattgtccttttttaattcggacataaaggtgcttgtttcaatttcttgggacgatgttgtcccattatcgcgcatataatacgcaaaaccggtgaccagcagcacaaaaatgatgatatacgtcagcgtgctactgaacaggccgttttgttttttcttcatttagaacctccggcaacattcaattagttccttacatactaccacaaacacggcacttagattaagattttgccgcatagacttctggctttaataccccaatataaggtaagttacgataacgttcggcataatctaagccatacccaaccacaaattcgtttggcactgtggttcccacatagtctgcctgaacatcaacaacccgtccttcaggtttgtccatcagcgcacaaatgcggactgattttgctttgcgggttttaaaaatatcggttaagtacttcaaggtgcgtcctgtatcaacgatatcctcaacgattaagacatcgcgatccttcacgctggcatcaagatctttaataatcttgacctcaccgctagattcagtcgcatcaccataacttgacacgtccataaaatcgagttccatataatcatcaatttcgcgaacaagatcagtcatgaacatgatggcaccttttaaaatgcacaccactaacggattcttccccgcgtaatcacgcttaagttccgcgccaagtcttgtcgtgatggcgtgaatatcgtcttgagaatacaaaacctttaaaatatcgggattcatcatttatcctcacttctgtcaacatctggcaatttcaccagtacaacatggagtatatcagtttgagcagggagcgacaatcgttctaaaggctgaccttcaatccaaaaaatctgatgaccttgcgctaataccagtaattgatcgcgtgttcgggccggaacctttgcattgataaaaaatcgccgcagcttctgcttcacgccattaggcaggtaaacaatatcaccggcctggcgggtccttaatgtaatcggcaagcgcacacgtaccggaataccttggtcaccagccacttttgtttgtagctgaaatgtaccgcgagcagtttggcatttttggccaatacgagaaaatgttgccggcgctagttttggttttggcaccaacttcacaattttggccgcttgaaccgcaatcgtcacgccagcgccaagatcaaatcgtcgttcgcgagtatcattcaggcttttcaggatcggcatgagcagtccgtggttaactcgcggctgccattggcgtagcaaggttaccagcagcatcagctggatcgtgcgcggctgatttgctgccgcgcgccaatcaattgtcaccgaattaatccgcaaccgctgctgccattcactcagttgcatttgagccagtgcaaccaagcccgactgttccgtcgtaaatctttggacatgccgcaacaactcgggattttgctgtttaaatgccggaatcacttgatggcgcaactgattgcgggcataacgcgtatcggcattggatggatcgtcgcaaaaatccagaccgtgcctgtttgcataagctcgaatgtcatctttactaaaattcagcagcggacgcaccaaccgctttttacgccacggttgatccgggtgaatccctacaagggcggccggatcaccggagcgtcctaaccgaaacaggaccgtttcaagttgatcatccgcgtgatgcgctgtcatgatcaccgtggctgcctgagaatcggcactcgcattcaagaagtcgtagcgtgcctgtcgcgccgcagcttcatttaccgcagtggcggccgatcgctgccatgttccagtcacaaccggaacatgataacgcgctgctgcggccaccacaaatgcttgttcctgtcggctttctggccgcaaacgatgatcaaacgttgcgacaacgacatccagattcggtgctcgaactgccaggtccaacaagaccatcgaatccacgcctccggaaactgccactaacacccgggtatgcggcgtaaactcaaactgttcaaaaagctttggactcatgtgtctgctcctccgcttagcatacttggccaagcatattgatcgcataaccactatcaaatcggcttggcaacaaaataggcccagaacaaataaccgtttgtcccagacccgatttttttaactacgccgaccgcctcggccgccgcgtttgccttcggtattgcggcgaagaacacttagacgatcttcgctttctttcaaatagccggacatcattgcatcaaaatcgccttttaccggttgggctttgtggccgaatcgattgccactattgcgtgcgccgccttggaagcggttattgccagcatgtggcgcggatgcgtgtcggttttcgtgatgatgatcattttcacgttgttgcggtttgtcaactgctttccggatagacaggccaatcttaccatcttggatcgaaaggactttaaccgtcaccggttcgccaacatgcagcacatcatgaatatccttgacataagcgtcagagacttcgctaatatgcaccaatccggtcttgccatcgcctaactcaacgaatgcaccgaatttcgtgatcccggtgactttaccagccactttcgtaccaatttcaactgccataaaaaaagaagtcctcctaattaaatgtatctataagtatagcatgagtgaaaagacacgcaagcacgacgtattagcctaaccaaagcaactgaatgcagtcgtcaaaggcaattcgccatgaagaaaacatttcagcgtctgtgctccccgccaatgcttgccacctcatcaagaataccactgaatctcaaaccaacaactctaaagtagccaaatgactgcagggacgcgaatatagaaaacgaccggcacttgcgtttattgcaacccgtttatcgcgtcattgggtaacgtttaaatccggcactttgtttgctttatccggcaaattaaaaataatctctcccggtttcgaatagaggtatttttcacgaatcagcttggccgtgtaatcgtcattatgcaattggtcaacctgaactttaagggcggctttgttcgcctttaatttattcaaattagacttggctttggcaaccgcctgatttgtttcccccagtgtcatttgcgtgcgcattaaactgacgccgcctaagcccaaaatagcaaccatcacaattagcaaattacgaattcgtttcatatgtaccgcgtgtgcccgcgacttaggcacacgtgtcgacttttgcctgtgttcacgtgtatatgcattatttaattgactgatattatttttcgccatctgtctgcaccctcgttttcaccagccgtgtatcactacttcagtaaatcaagtataacaaatcagaggggctgctgttcaataaatcggcattaaaatgtttctttataatcttctttcaaaaccgtgtacatatcggccgcttcgttctttttcgttgtttcaactaagtcatccgcacgtacggtcaatgttttgttaccgaaattaatcaccagcgtgtcgccaaccccaacatcggtactcgacttggcaactttaccgttgatcgtgatccggcccttatccgcaatttccttggcaacggtgcgccgtttaatgattcgtgagactttaaggaacttatccaatcgcatgtctttttacctcgcttttattcgtcgtaacaatcgtaaatacttttttccgcctggcagatctagcatctcgcgtaacgtcaacaatcgcagccatgttccggcgatcaagaagaccatgacgccgatgacaacgccaagtaacgtgacaccgactgccacagttcttgagctcagcggaatccatcctaccgtgacatgcacaataaccgtcataatcccggtcacggcgacaagcttgggtacaaacaaccgcagtgcacttctgcctttgatcgtctcaggaactgcataataaatcaagcacaggatcacacccaaggccaaaattgttgctccgcttgctcctgctgttccaaagcgcatcaccagtggttcattgctcagcgccttcaccacgatgccgagtaataaagccacactgattcctgtataccgatcaaggctttgtaaaatcgcattatacgcgttgatcatggcaacaacggcaatggcaagtgcatataactgcaaggcataagtgccagctgtatcgccaaacaataatagattaatcgctggcatcaaaacaatcagtcccgaagccgccgccaatgcaaaggctaagttgaaatggactaattcggctccgcgttgaatgaactggcggcgctgccgtaattgccgcgcctgagtcagactgggtagcaacgttgtagacaaagacgctgccaccaccaagcccaattgaaccagtggctggccgcgatcataaaccccttttaagctcttggcagttgccattgcaatccctgaacccgtcaaacctttcgtcaccgtgaagctgtcaatcagctgtagcaagatcaacaaagccgcataaagcgtaatcgccccaccttcacggataaaccgactaattaagcggccgtatgcgtgaagcccgggaaattgatactgctgctgaccaaacacttgccgataaggccgccataaagtcaaagcagcggcagccccgccaaaaaatgccccactcatggcaacagcgcccatttgataaacactccagtgatattgcagaaaccaccaagccgctagcagaatcaccgccacccggacaagctgttcaaccacttgactcgtcgcggtttttaccatatcaaaagtaccttgaaaataaccgcggccagttgccagtagcggcatggttaagaacataaaggccaccatttggattaacggcaacaattccggatccgccattgcctgcgcaattgcgggcccaaaaaattcgagtcccaaaaataacgcccacgaaatccaagtcaaaatgacccgactttgatgggccacggttcgtttggcttcgagactgtcagcttctgcaaccagcttggagatataaaccggaaaccctgacaacgcaaacgtcatgcccagtccataaatcggataaatttgctgataggcgtaaaacccagtgtcgccaaccatattctggaaaggaacgcgataaacggcgcttagaatctttgcaatcaaggaactaagactcaagatccacgcaccgcgcatcaaatgtttcatttgttgattatgcatggtgatctcctatcaacatcgctgtatcgctgtgccaaaataacgcagcgcacatcgatatccagcagttcatcttattaggcggcaggctttttttccggctgcggattcacaaccgccagcaatcccttcatgaaagcagttagttgccctagccactcgtcttctttcatggttgctggcacagcgagcgttaccgtcagctttccatcggcaattgctacttgtgctttcaaagtcgtagccgccaacgccttaaagatcggttcgccttgtgctttagcagtcgcttgcggggttaacaccaccgtcattttctggtcgtttttctggacgtgatccacccaagccaaatcagcgaaacgtttcagatgtgcgattgccaaaagattcgtcaccggctgtggataatcgccgaatcgatcaatcaaatcttcactaatctcggtttcggcttcatcactgtctgcttcacgaatccgtttgtacaattcaattttctggcgcgaatcggcaacataatccgttggcaggtaagcttcaagacccaagtcgatttccgcatcggttttttgaacagttttaagtccgcggcgtttgttaaccgcctcttgtaacatctgcgtgtacaagtcatacccaaccgaatcaataaatccatgctgttgtttgcctaacaagttccccgcaccgcgaatcgacaaatcacgcatcgcaatcttaaagccgctacctaattccgtgaaatccttaatcgcctggagccgtttttcggccacttcattaagtaccttcatcggttgatacatgaaataagcgtatgcaacgcggctggaccgcccaatgcgtccgcgcaactgatacaactgggacaacccataatgatccgcattttcaataatcagcgtattggcgttcggcatatcgaccccggtttcaataatggtcgtggtcactaatacgtcatacgcgccatgcagaaaatcatagatgacattttccagctgggtttccgtcatctggccgtgggcatacccgatgctggcgtcaggcactagctcttccaattgactcacggttcgctccatatcctccacccgattatgcaggtaaaagacctgaccaccgcgttccatttcgcgttcgatggcttcccgaatgaccccggggttttgttccattacaaaggtctgaatcggatagcgatttgtcggtggcgtctcaatgacacttaagtcgcgaacgcctagcatcgacatgtttagcgtacgtggaataggcgttgccgtcagcgttaacacatctacattgcttttcaattgcttaatccgttccttgtgcttcaccccaaaacgctgctcttcatcaatcaccaacaaaccgaggtcacgaaatgccacatctttagaaagcagtcgatgggtgccgacaacaatgtcaatcgtgccgtttttgagtcctttaatcgtcattttattttggtgcggtgtctggaagcgcgataacaagccgattttaaccggaaaatcggcaaatcgatccttcatggtgtcaaaatgctgctgcgccaagatggtagtcggtactaaaattgcgacctgcttaccatagtcaactgctttaaatgctgcccgtaacgcgacttcggttttgccaaagcccacatccccgacaagcaagcgatccatgggtttgggtttctccatatcccgcttaatttcttttgccgatcgcagttgatcaggcgtctcgggataaggaaactcatcttcaaatttttgctgcagatcatcatccggcccgaaagcataacctttttccgcttcccgttttgcgtacaagtcaatcagctcgtcggcaatgtcttcgattcgagccgccactatgcgtttggtcttttgccactcggtaccgccaagcttattgacgttaggcgttttgccatctgcagaaacatatttctgaaccagatttaattggtcaaccggaataaacagtttgtcattgttgcgataaacgatggtgatgtaatcgcgatggacaccgtcaacttcaagcgtctccatgccggtatattgcccaatcccgtggttgacatgaacaacataatcgccaggctttaattcattatagctgcggaggcgttccgtatttgccaacgtctgatggcgagcccgccgccgctgccgagcattgaacagctcgtgttcggtcaccactaccagcttcaaatccggcaattcaaagccgttcttcagactgccatcggttaactgaacttttcctgaaagcagctgattaggttcggtcaccacattactaatctcaaagtcatgtaaggtggcacttaatttctccaagcgattcttatcggaaaccaggaaaaccacggtctgtttttgtttcacccaccgatccgtttcggttttgagcaatggcatctgactaaagaattgttgaacattgcgactcggcacgttagtcaagctatccaaccgcaactgacccattcctttttggaaaaggctcaggtaaagccgcggatgccgatcacgctgattaagcgcttggatcgtaggattaggtgttttaggcaacaaacggccttccgcttgcagctgtgaataccattcagccgtatcctgcaccaaattcgtatcactatccaacaggcgactgtaatcatcaaacgctaccagcgcatcactggccagataatcagtaatgcggtgatgttccggatacagctccggcgcatacaatgccaggttttctggccgttctaatgcttgtaactgctggctggtcgtcaacaagccatcggtaatcgcttgctttgccgctgcatccttgactttcgctttgtaagctgttgcctgcttaccgattcgcgcaccggcatcggtcagcacctgatcggaagcgatcatgtcagtagccggtgcaatggcaatctgatcaagctttttcaaactgcgctgggtagcaatgtcgaagctgcgaatcgagtcgatttccgtatcaaacaactcaatgcgaatcggatcatcctgatttaatggataaatatcgataatcccgccgcgaatggcaaattggccgggcgcactcactaatgaatcacgccgataacccatcgccacaagctgcttggcgaccgtttgcggatcaagctctgaatccatatcaacaaccaactcacttgccgcccatgcagccggtgcgggtaaaattcgcttatatcctgccaggctggtaacaataatgcccggttggccgctttgaataaaggtcagtgcgttgatccggtcgttgcgggtttccggtgaactgaccgccacttcagccgccaatacatcttcaaccggaaaatcataaacaagcgcatcgcctaataaactactcaaatcggctgccaactcgtctgcatgaaaccgattattttcgacaatcagcagctgctttttttgctgctgcaagagtgcgccaaaaaagaccgtcttggccgaacctgatagtcctgtcaccaaatggcggcctgtctcgagcttaggccataatgccgacagttccggatctgcctgcaccatgtcgattaaattcatcgctccacctgcttctttcatattcttcaagtttacccattaccccaagcttcatcagccagcgagggacaagttttaattaaacttattcatcaactgggcaaatggcatgccgtttagccaatcttccaatgcatcatccgctttagtgatagcagcatctatcactggttgatcggttttggcaaatggggtcaacacccagtccacaacccgctgccgctgcgggtgctgaatgccgatctttaaccgatagaattcgtcacttcccgtagcgctgataatgtccttgataccgttgtgaccgccggctgatcctcgctggcgcaatcgtaacttgcccaatgtcagatccatatcatcgtgtaccactagaatttcgtctaacctaatctggtaatacatcattaactgccgcactgcgcgtcccgacgcgttcatataggtctgtggtttaaccaggaaaactttttcatcatgaacacgtgtcgttgctgtagcagcatcgaattcaagcttgttaagggtgagccccattcgctgtgccaagccatcaaccaccatgaatcccatattgtgcttcgtgcctgcatattgacgtccgggatttcccagacccacaatcattttcatattatctcctcatcgtatcgagcttaaattcatgcaatcctgcttggtttaccggtgatgctgacacttaaccaagccaagcgaagaacaccaaacgcctaacccaagtaaggaagttagctgtttggtgttgcttcgccgaatgttaaatgctgcatgtccgcgcactgttttctattagtaagtagtataacacatgccggctgactgactgtatgtctcactttctgcgaactgttaagttttgttaattcgtgaaaatagatgttgcaagcgtttacgttcctgaaagccagcttgtcgtaggattcacaagccttggcattgtaaggctcagccccgctttttaacaatgacaaaatcatgaaaaagtcagtcaattttgtttcagtgatttgataatgtgttatactcacaatgaaatgcagtttgcatgcacataagaaaggatgatatcaccgtggcaagtattacggataaggatcaccaaaaagttattctcgttggtgatggcgccgttggttcaagctatgcctatgcaatggttttgcaaggtatcgctcaagaaatcgggattgttgacattttcaaggacaagacgaaaggtgacgcaattgatttaagcaacgcgctcccattcaccagtcctaagaagatttattctgctgaatacagcgatgccaaggatgctgatctggttgttatcactgctggtgctcctcaaaagcctggcgaaactcgcttggatctggttaacaagaacttgaagattttgaagtccattgttgatccgatcgtggattctggctttaacggtatcttcttggttgctgctaacccagttgatatcttgacttatgctacttggaagctttccggattcccgaagagccgggttgttggttcaggtacttctctggacaccgctcgtttccgtcaatccattgctgaaatggttaacgttgatgctcgttccgtccacgcatatatcatgggtgaacacggcgacacagaattccctgtatggtcccacgctaacattggtggcgttaccatcgctgaatgggttaaagcacatccagaaatcaaagaagacaaacttgttaagatgtttgaagacgttcgtgacgctgcttacgaaatcatcaaactcaagggtgcaaccttctacggtatcgcaactgctttggcacggatttccaaagcaattcttaacgatgaaaatgcggtactcccattgtccgtttacatggacggccaatatggcttgaacgacatctacattggtacacctgctgtgatcaaccgcaatggtattcagaacattctggaaatcccattgaccgaccacgaagaagaatccatgcagaagtcggcttcacaattgaagaaagttctgaccgatgcgtttgctaagaacgacatcgaaacacgtcagtaatcttcaccataactgattttaaaccggcatcaaccgtgatttaatcagtgagtatcaaagtagatcaaccccagagacgaaaaacgtctctggggttgatttcgtttacgccaccacaaccgatgcaggtggcgtcaaccaataccgaagatggccgactcaattcccatatcatcaccagtccgtgcttttcaaagtcattggcttgcgcttcgtttcataatgtttttttaagtttaccgttcattaaccgtaagtggtatgataccgcagttccttcaccaccgttcgaggggcgttgcttttatttccggcgttggtatcttataataagtaaaaataacgtcatttttgaggaagtgcttgttacgaaacaggaacaaacaagaagcaggaggcagcaatcagtgaataagaaaaaatggtggctcctcgcgctcggcgccgtagtcattcttctaggcggattctatatcttccgaagtatgcactaccgcgatcattttttgcccaatacagaagttctgggcgttgatgtttccgatcaaaccgttagcgcggcaaataagaaactcatccaacaatttagtgaacgccaatatacctttgttgaagatgataaaaaagtcttgaaagtcaaaggcagtgctttgggtatcagtcaagacttcaagcaaggacttactcaagtgctgaataagcaaaatccttggcaatggacaacttccatttttgcgggccaaaaagcccatgccgaggaagacccgtcaattaataagacggctttaaccaagtttgctcagacgactgctgacaagcttaatcaagggcgtcaggggccggaaaatgcaaaactagtcgcggatggcactaaatataagattcaaaaagaagtcaacggtacccaaatcgatgcggataagcttgcaacaacggtaacgaatgtccttgataatcatcagcaaaccgttaatctggccgctgcgtacaagaagccgactgttaccgcgtctagtagcagcttgcaaacaaccgaacgcgacatgaacaagctggcagggactaatgtttcattgcagattcagaccaaaacggtgaccgttccgcaagcaaccgtgatgagttggatcataaacgataatggcaaggcaacggtttcaagtcaggccgttaccaattacgtttctgccttatcgcaacagtacagcaccatcaaaaaaacgcgtcaattcaactcgcaacaacaaggaacagtgagtgttcctgctggcacctatggctggagcattaatgttagcgccacaaccgccatgattgttgccagtgtcaaagccggacaggatctcaataaagaaattgtccacaacggttccggttactcaacagacggcgacattggcaacacgtacgttgaagtatccaaagaaaaacaacatgaatggtatattaaagatggtaaagtcgtcatggactccgacattgtcaccggtaagccaggtcaagacaccccatccggcgtcttctatgtctggtccaaacagcgtaacgcaacgctacgtggaaaaaacgacgatggcagcgactacgccagtcctgtttcgtactggatgccaattgattacaccggggtcggcctccacgatagtccgtggcagcctaagtacggcggcgactggtacaaggaacacggatcgcatggctgtgtcaacaacccgccagacttcatggcaaagttgtatgccgcagttgacgaaggcacgcctgtgatcgtgtattaagacctacctgataaaatgaaggtacaagaaatggcttgattccaaactactacggaatcaagtctttttttggccatgattggacgtacatgtttatccaatcagaattacagctgtcacctcgaagactagcggtgctctgagtcgtttcccttttgctcgtctgtctgtaaatatgcttttaacgtcttgatctgcgcctcatactcggcaatgccaaccgaaaaagaaagatgctgggttttagtcatgtttggccattcttttagccgcaactgtaatttgtcaatttgcattcctaaccacccaatttgctgttgaatcatcgcttgtaaggctgtatccgattcgtattcaccaaagtagagtcgcatcaagaaatctgaatgacgagtatccggaacaactgacgcatcaagcgagtcttcaaaaacctttttaccttcttcagtaatggcatattgatttttatttggtcgcccactttggacgaccatttttttggaaacaaggccattcttctctagacgtcgcaaggttggataaatcataccaaaagaagcgtcataaaaatgactgaaaatatttttaaagacttcgttcaattcgtaccctgttctcgaatgtttatatagcaagccaaggataatctgctcattattcatgctaaaacctccaatgatgttgtctatatcttaccacgttaatattaacggaaacaatattaattcttgacatataaatgagggcgcgttaatatccttttatattaatcccgttaatataaacgcaaaaaatatggaggcgcaacatgattaaatcagaatggttatctgtcttaaaacgaccaatggtgatcgttgttcttttcttcattactcttattccggcaatctattcaggtgtctatctctcttcaatgtggaacacctacgagcacacgaaggatttacctgccgcaattgttaataacgacactggtataaccgacaacggtcaagcggttaacgccggaaaagatcttgtcaaaggggtgctcaagtcagattcaatgcattatcacgtcacttcaaaacaagaagctgaccgcggtttgaaaaatggcgactattatcttgtcattgaaattccaaatcatttttcaaaagactcccgatcacttttaacgcaacatcccacggccatgaatatcacgtacaaagtgaatccaggaacagatttctttgcctcacaaatagcaaagggcacggccactgctattcaagccaagctcaaccaacagatttccgctatttactttaaaaatctaacagcaggggtcgtttctggaacccaaggcaacgcaaaattactaactgccattgatgcacttaatgccggcagtcaagccttatccactggtctgtcgcaacagaaaacggcgatcaccgcactcagtaacaaccttccgagtacagcccaaccgttggcaacgcagctaacctcatcgaacattgcattatctaacgctgcaacctcgctaacagctggtacggcaaaggttcaaagtaccttgacccaatcacttaaaacgcagcccaaactagccgtcgcctccaagaatattcgcttattatccgcccctgtcaatttaacccgtgttgacatttcccatacacctactaacggcgtcggcatggcaccattcgcgattgcaatcggcctttatgtcggctgcatctcgcttagttttatgtacgacatgtactcaccaaaaacaaaaccaaccaaagcaattgcatggtggtggagcaaatatagtctgctgttagttctaattgggattcaagtaggctgtcaggccatcgttgtcatgagcctaggactaaaaccgttatccattggcaacacttgtttagcaatgttggtcacggctatcaccttcataacctgtgtttttggcctaaataccattcttggtgctttcggcaaatacctggtcaccattttattgattcttcaactaggtgcttcgaccggcgtctatccgttggaaacagccaatgttttcacccgtatctctagcccattcttgcccatgacctatggcatccacgccatgcgcgaagcaatttcaataggcggtcaaatgacccacgacttggttgtcatgttagtagtcacccttgtcatcaatagtttagtcattgtcaaacttgagttggatcgtaaacacgaaaagtttagcgatcttgttgatgatgtcgtgtcatccatcaactagtctcgctggcaatcagcaaaaaagcagatcgcatgtcatcatccaggaggcgtcacaaggaatatggccactaaattaattttgatcgtgtattgtcacccttacacccacagctttaatcatgctgtgttaacgcacttagaaaaaaacctcaccgatcatggtcttcattatcaactcatcgacctatacggcgatcactttcaacctttttacgatattgaagagttgcgcttgttccatcaagggcaaacacatgatccgcttgttaaacattatcttgatcaattaaaaacagctcaagggatcattttcgtcacgccaatttggtggaacagcgtccctggcatgctcaaaggtttcattgataaagtgatgaaggaaggcgacggtttaacgcatactgtcaccaaaactggcgtccgcggctgcttgactaatttaaaacgagcctatgttttcaccacttctacatcaccaacattttggttccttaccacatctggaaacagcattcagaaaatcttcatcaataaaacgctgaaacaattgggcattcagaaagccaagtggtataacttcggcaacatcagtcatgcatcgaaaacccaacgcgatcattatctggtgacatgccagaaacgacccctgctcttttgaaagtcagagttattgcccggcactcatcaaacatagctatcaggtcgctgacagtcttcttccgcatgaacaccccagaaaaacgttacaccgccagcgaactatggtatcataaagcaagattagaacattttaataaagtgatagttgtttgatggaggaaagcgcatgttaattaagtcgttagtattaaaaaaggaattcctgaccactgtcaaggaaacggttacccttgaagaagcgctgaagatccttgaagactccggctttcggtgtgtgccgatcctagatgagagcggcacgatcttccgcggcaatatttacaagatgcatatctatcgccataaatctcaaggcggcgatatgagtttgccggttacttatctgctgaagaatgcaaccaaaaccattccggtcaatgcaccattctttaaggtcttctttaacatcaaggatttgccgtacattgctgttttagatgaaaatgccaacttctatggtattttgacccacgctaaactgcttgggatgctgtcagaagcatggaatgtcgatgtcggttcttacgttttgacggtgatgtcaaccggtgaacgcggagacctggcaaaaatgagtaaaatccttgctcgctacgtttcgatttccggttgtatcacgttggatgctaagcgtgacgagtttgtgcggcggacacttttcaccttgccggccggtacagatgaaaatacattaaatgaaattgtatctcggctagagaagaagagcttccgggttgtcgaaattgatgatctccaatccggtcagccgcttcgagtagacgaagagctttaatctgcccaatcacgtgcgccatcagtacaagacaagcgtgtaagaacctcggacacaaccattaaggccacttagccgttcgtttccgactagccgactcacgcttacaaaaagctcggcagcattgactgtcgggcttttgtgatggttgaaaaatgccatgatgatacgagcaaaggtgctggaatcgtgcactggtttggactttggcgatcctttataatacagtgaacagtgaagttgttttatttttattgctgcaaatgcatcaagtgcgaatagaaaggatgctacatgtgaaacgaataaccgaactgatgcatcatcttgccgcgatgatgcattaccttcattcacatcatctgaaaccaaagtaccggaatcgcctgcttttcattgctgtcttcataacggtgtgtttgatcgcagtctttaccggacaacatgctaaagagtcagcttcgacagcgtcaagctatgcatcggtcacaaaactcgccaagactaaccacacgccgagttacaccgctgctgaaattactcgggttacgcctaagaagattgactggaaagcaccttccgaaagtcggccttatcctgacgtctccaagcatcccaacctctctttgcatgtaaacttgaaaaagcagcgggtatttattaaagatggcagcaaaacgctttatacaatgtatgcatccacgggcattgacgacgcgaccccgcatggtgactttaccattcaggatgagcgcggttatgaattctttaatcctaacgagcaaatgggtgcacattattacaccagtttttacttacacggtacctatctttttcattccgtaccgacagatatcaacggcaactacattcaatccgaagcagcaaagttgggtaaaaagccgggatcacacgggtgcgtgcggctgagtatttctgatgccaaatggatttatgaacatatcccaacaggaacgccggtttcaattcattaacagatgcctatcaaaaaagtcctctgtagcaacttattcgttgccacaggggacttttttcaaaggctaaaccgccaacctataacgcttcacttgccaatgtttgcaaggacgcatcgactttttccgcacacatgcggccttcgtgaatcccccaaataaccaagctggggccgcggcgacaatcgccagcaacatagatctgggtatcattggttgtgaagttagcattcttggcagtgatcccaaatgcatcaaaaacatcagcttccggaccggtaaagcccatggccagcaccaccagatcaactttgactttcttctccgttcccgcaatcggtttaaaatgatcgacttggctaatctcggcttcactcacttgaccatgctcgccaaagaaagcagtcaccgtagcggcataggtggtcacatcaccgccaaaaagcgcttttgcctccttctggccataaccggtttttaacgtcatgggccactctggccactgattgccagcaggacgcttgggtggtaacgctggggtgatttcaagttgcgtcacgccggcacaaccttggcgaatcgcggttgcaatacaatcattgcccgtgtccccgccaccgagaaccaagacgcgtttacctttcaattgggtattcgcttgggtgccatctttgaggaccgtctgagttgctgtcttgagaaaatcaactgcctgaacaataccgcctaactcgcgccccggaacttgtaactcacgagcctggcgagcacctgtgcaaacaataacccggtcgaattgccgcttgagttcatccgcggaaatatctttaccgacttccgtattggcaactaattcaatcccgacttgcttcagcgtttcgatacgccgctgtacaacagtctttggcagcttcatgttgggaatgccgtacatcaaaaagccaccgaagcgatcatcccgctcaaatattgtcacggaatggcctaactgattaagccgccatgctgcggaaatgccagccggcccactaccgatgaccgccacttttttcccggtacgttgcagcggctttccggatgcaataacccagccatttttgaacgcctgctcgatgatgtacttttcattgttacgaatggtaacgccgggaccgttaagtgcttgaacgcaggaaacttcacagggtgccggacaaacgcgtcctgtcatatccggtaacatgttggagcgactcaaccgttcaaacgcccgcttgtcttccgcacggtaaaccagatcgttccattcgggaatcagattgtcattgggacacccgctgaccgcgcgaccgccaccataaaagacaccatgatgacaaaatggaatgccacaattcatacaccgcgctgcctgtttacgtcgttcctccatgctgacgtccagttccaacgcatcaaaatccttgacccgctgcataattggacgcatgggattatctttgcgctgatacttcaaaaagcctttgggatctgccatcacgttgccctcctcatatcattcgtaggtacttctttagtcgtgcttttatcaaaatcatcggctagtgtccattgcccatcgccgtgtcaaaagcctgctcaatgacctgttcttcagacaactcgggcttggtaaacttttgaatgagatcgcgcatcttatgataatcacgcggataaactttcacgaactttgttttctcggtttcccagtgtgtcaaaatcatttcggccgtctcggattgtgtatattgcacatgctttttcaataaatccagcagcacactatcatcgcctgcttcatctagccggtacaagtccacgagctcctgactgcaatttttggcaaagtcatgtgcccagtcgtaaacatacgcaacgccaccggtcatcccggccgcaaaattgcgccctgtgcgccctaaaatgacggcaaccccaccggtcatatattcgcagccgttattgccgacgccttcaacgaccacttgtgccccggaattacggacacagaaacgttcaccggcccgcccgttgaagtaagcctcaccgcccgttgccccaaagcatgcaacattgccgacaatcggtgaatgcgtataaagttcacgcgcctgttctggtgccgccacaatcaaccggccgccagaaagtcctttacccacatagtcattagcttccccgaccagtttgatggctaatccttgcgtaataaacgccccaaaactctggcctgccgtaccgtgatagttaaactgcagctgccccggtttcaacccattattgccaaaatgcgcggcaatccatccgcccaggcgcgttccaaccgcccgatccacattattaatcggtaaatcaatcaaggtggcattttgctgtttaagactggtttcagcaaaccgatccaaatccggccagtcgtattttggcttaaatggattggcttttttacgcgcaatcggaatcgtcttgcctaacattcggtcataattcaatgtctttgccttgccatatggcacatagcgaggttttaggtgttctccgtgtccaaccatttgatctacggtgcgataacccaaagccgccatttgttcgcgcagatcttcggctaaaaattgcatcatatgcatgacgttttccggacgtccggcgtagagtttgcgcaattccggattctgggtggcgatgccgaccggacaggtgttgagattgcattttcgcatcatcacgcatcccagcgctaccatggtcagggtgccaaaactgaactcttcggcgcctaacatgatcgcaaccgcaatgtcgcgcccggttaagagtttaccgtcaacttccaaagtcgttcgctgccgcaatcgatttaatgccagcgtctggtgggcgtctgccaatcccatttcccacggcaagccacagtcacgcgtggagtttcggggagcagcgccggtcccgccgtcataacctgagatgacgaccgtatccgcgccggctttcaccactccggcggcaatcgtgccaactccggtcgaggacacaagcttaacgttgatcttggcataaggattgacttgtttgagatcgtaaatcaactgggccaaatcttcaatcgagtaaatatcatgatgcggcggtggtgaaatcagctggacgccggcaatcgaaccccgaatgctcgccacccacggatatgccttgccagcaggtagttgcccgccttcaccgggtttagccccttgcgccattttaatctgaatttcttcggcactcatcagatactcggtattgacgccaaatcgtgccgtggaaacctgtttgatcttactgttgcggttaacgccatctgccccgacatggaaccgattgcgattttcaccgccttcacccgagttgctacgggcgcccagccggttcatcgcaatcgcaatggtttcatgcgcttcttctgaaagggcgccaaaactcatcgccccggccttgaagcgtttcacaatggcactgaccggttcgacctcactcaaaggaaccgcttgttggccgcttggtacgatcgtccacatcgaacgcaaggtgaccggggttgttttggcttcctgttctacttccgctgcatactgctgataggcctgataatcaccgcttctgaccgctttttggaactggtaaatgctcttagggttataaagatgcgcttctccatctgccttgaattggaagctgccgcctgaaggtaaatcatcaatggcatgatgactgaaagccagttgatacttctgatagtactcattttccaactgattcaggttaatcccgccgattcggcttggggtgcccgtaaagtattgggcaacgacatcatccgccagtccaaccgcttcaaacagctgggctccttgatagccggcagtcgtcgaaatccccatccgactcataatcttaataatgcctttggtggcagcagcacaaaatgacggcagttgctggtcatagccgcgctcacgcaaggtggcaaatgcgccataaggatgaatggccgccgcaccatacccgaccaagcaggcaaaatgatgaatttcgcaagcttcggccgtatccaccactagcgatgccgctgtccctttgccttgacgtaccagataattgtgcaatcccgacacggctaaaagaaccggaatcgtcagctggttatcggcaactggccggtcagtcaagattagaatcgtcgccccgttatcaatcgcattttctgcttgggtaaacaattctttgagcacatgtgccaggcgatcaggtcggtccgtcaagtcgtaggccaaagataacttagcgaccttcaaaagcggcaagtccaaactaagcactttagcgtatgcccggtcatccagaatagggctgtcaattttgagtttgtgacaattgtccgcagtatcgcgcgtgcaatcgccatcgcggccaagaaaaccaaacgttccaatgaccactttttcccgtaatggatcaatcggtgggttggtcacctgcgcaaaagattgtttgaagtaggtgaagagtgattgcgggtggttacttaaaactgctaatggcgaatcaaaccccattgccaagacaggttcgccgccgttttcagccatcgggatcaacgctgtctgaatgacttcatgcgtatacccgtgccgcaaccatagttttttgagctgatcaggtgcaatgtcttctttaggctgaacctctggcaattgatcaagtgtgagccgattagcattgagccattgttggtatggatagccttctgcacaatgccgttttagctcatcggttttgaaaatccgccctgtacttgtatcaagcagcagcatttctgcaggtgccagaatccccttttcaacaatatcgccaggatcaatatccacgaccccggattctgatgcgacgaccagttggcgttggttggtcaaggtataccgcgatggacgcaatccgttacggtcaagaaatgcgccgacttgaataccatcagtgaaacataaagcagcgggaccatcccacggtgccataaacgtcgcattatattcgtcaaacgcgcgctgttcatccgacatttcggtaccggcaccccaggcttccggtaccatcatcagcaacgattgcggaattgaacggccgtgtcgatataagtattccatacagttttccagcttagcagagtcggaatcggtttcgtcataaatttcgataccgtggcttgtcatccaattttcggcgcccttaagcgtattaatttcgccgttatgcgccagaaaacgaaacggttgtgcccgatcccagctgggaaacgtattggtcgaaaaacgagaatgaatcaagcagatagcactttgcatttgtggtcgatgcaaatccggataaaaaagactgacttgatacgcatgcaacatgcctttatagactagcgtacgactggaaaaagaacaaatgtacattgattgccgatcaaaggtcttttccaactggcggcgtaacgcatataaatgatcctcaaattcacgcccggcctttgtgtcagctggacgttgcaccacaatctgaacaaaacccggcattgcttgttgcgcagccggaccgcaattttcataaataaacggcacgttacgggtccaaagtatcggaaagcccgcgtcatcaatttgatcaaccacagcctgcagcatggcggcctttttggcttcatcatggggtaagaacaactgggcaaccgcatagtcacccttagccggcagtgtcaatcctgcttgcgtcatttcatcgcgaaaaaacgcatccggcatcgccatcaagattccggcaccgtcaccggtatcaggttccgcgccagtacccccacgatgattcatccgctgcaacatggtcaatgccttttccacgatttcatgactggcatgaccatcaacttgggcaataaaacccatgccacaagccgcatgctcatattcaggcaaatacattagattggtatcatcttttaatcttttcatagaatctccgccttattcattaacgtccggtccttatcagcgttattgttctcatattattctaatcatgtctcattgacaagatttttttgaccgaacacgcgtgatgattgcgcatatttgttttgtcatgcacaaattaaattgccgtcataaccacaaaaaaacggctccaagcaggcaatttgctgctttagaaccgtttatccgctgtaccatgacacgcttataacttcaaataagtcttcacagattccaaataaaccctgtatcacgaaagaacttaggcaccatccctatttttgcgccatggtcgtccgaaaatgaacaatccggtcaagtgccagcataactggagcagaaagggtcatgacaatgaactcagacagcatcagagatccatatgttggcagaaacatggtggcaaacttcaagtgaccggtccaaataatttcaactgcaatcaacgccattgtcagtgtcatgaccgcaatattcaacgcaaaacgttgccataattgctttagcttaggcgccaaccaagctaccaacaataaccctataaggctctgaccgccaccaaagacaacatccaaccaacctaatggcgaaaaaatcgcgttaaaaatgacgacgccagaaaccacgccgatcaagtagcgccgatcaaagaccactaaatgattcaagctttccgagagtcgaaactgaatcgccccgctggcaagattaaggctggccggtcctaacgataaaacaatataaatagccgccaccaaagcatttaaaacccaaccgcgaatacccatttttgtttgcttcataccgtttaccgctcccttacttaagcttggttatgtattacttattctccataacacgctccccggcgcaaggatctgcgtgtaaggaccttgggcgcaatggccaaagaccggccatacgtctgagaccgcttatgttctggtttacgcccatagcgcgttcgccagcccagaagcctgcgtgtagggaccttgggcgcaatggccaaagaccggccatcacgcccaaggccacttatgttctggtttacgcccataacgcgttcgccggcgcagggatctgcgtgtaaggatctcaggcgcaatggccaaagaccggccattgtgcctgaggccacttatgttctggtttacgcccataacgcgttcgccagcccagaagccgggctggctcacgctcatcaaaaaagcgcctctttttcatcgaggcgtttgcttagtttttattatatgttttcggcttaggcaagctgacgagtccgaccgatatcgccagtgctcgatccaccgctgccattttggcacttgaaagagcggtaacgcgtgcctgtaaccgttgcttatcaattgtacgaatctgttcaagcaaaatgactgaattacgctcaaccccgtcttgcttggcgcgcaaaccgacatgagtgggcattttgggtttttggattttggaggtaatggcagccacaatgacggtgggactatagtgattgccaacgttattttgaataataagtacgggccggttgccgccttgttccgacccgacaaccggcgataaatcggcgaaaaatacatccccgcgtttgactgttacatccatgctttggcccccttgctgcttatcgaatatgggcgtatgcctcactttcgcaggcggagaaagcatggctgatttccgtattgatttgtcccattgccacatagcccgaaatcaactgattgatctcaggtgcttgtgactgcaaaaacttcgccactgcttcagtaatgacatcctgaacacccatatcattcaactcacaataggcatccaaacgcgctttgatagcactatcaagcgcgaccgttactgacgtttccttcttcatgacaacttcctccaacttcccaagttcatggtgatactttagcacaaaatcagctgatgggctacctgtcaaaaaatcgcctcgtctcatcctgtgcgaccgaaaccgattttaacgcgcaatcgggttgatactttgacgtttcaaccgcgatgttaaattgcaggcaatttcataatgaatggtgtggctatacttagcaacgtccaatagcgtaatctcctggtcgccactttgcccgattaacacaacttttgtacctgccggataagcttttggcaagcgaatcatgaactgatccatacaaattcgcccgacgatttcacacagatgaccatcaactaagacgtgaaagccctgtaaccgccgcagccagccatctgcataaccgactggcaccgtcccgataaactcatcacctgtagcgcgatacgtcaccccataagaaatcccatcgccggcatgaacttgcttgcaaaaagttaattcgctctccagtgacaaagccggctcaagcggaaacggtgtggtcggaatcacatcacctgatggattcaaaccgtaaattgccacaccataacgaaccatattgccgttacatgctgcatgccaaagacttgttgccgaatttgacacatggacatagcgtggccggtgcggtaacaaagccaccatatggttgaatttggcaacttgctgtttgaagtaagcatcatcaggatcatcagccgtagcaaaatgcgtgaagatcccttcaatcgtaaacgccttgggatgtgcctgaatgaaggcaacggcatccaaaagtgtctgatcatccgtaaatccgatccgacccataccagtatctaaagcgatatgcagccgcaatggtggtaactccggttgcgcctctaaaactggcaaggcctgcttgagccagtcaacactactgagcggtaacgaaaccgtctgcgcagccgcaatagcagcatactgactcggaacgattcccaaaaccagcactggctctgtatagtttgccgcccgtaaatccaacgcctcatcaagcaacgccacacaaaaaccgctggcaccggccgccttagccacatgcgccacccgcaacatgccgtgtccatatgcatccgcctttaccacggcaaacagttgcgtctgctttttcaagcgcgccacctcatgttgaacattatgcaaaattgccgtttcatcaatcaaaaccgttgctggtcgcaagttaccgatcgtcacgttcaggaccttctttttctaatattacctcggtaaacaccaaagtctcactatgggaaatggaaacaaatgcctttccgggaaagggatgtttcgtcacaattggcttgccaagttcgttattcaaaacttccacatcttgcaaggcaactttacccagccctgtcccaaaagcttttgagtaggactccttagccgaaaagcgaccggataaatactccaccgctcgccgaccatcgagttgttgataattcgccaattctttcggcgtcaaaatcttagcagcaaatccatggttcttctcttgagccgcttgaatccgcgccaagtctgtcacatcaactccaataccataaatcatggccgcctcccacaaatctgtgataccgctattttaacatttcaccaaacagccgcctagtgagcacgaaaaaacgatcccggaagatgcagacttgcatcaccaggatcgcttttcagcactggtcattgattcgcatgaatgaccggtctattaacgtactggtgattattcacccgtacggattttgaaattacgcttaacgtttttacgtttgtcgccaaagttgcgcttcttgtcgtaactgcgcttgccatcgcgattaccttgatagccgccatcgcgtcgcttgcctttgtagccgcctttataaccgccacgattgttgccatggccgtgattgttgcggccgcggcgtggtaatggacgttctggtgtaattttaaccggaacggcactcgcatcgtcagggctgactgccttgagatacgccgaaaccagctgcaacggggtgtagttttccaacaaggtttcagccattgcttcatacttttcggtatcgttagcttcaacttgttccttgatggttgctaagccgctggagatctggcccattaatgcttcttcagctgtcggcggcttcatcggtaacatccgcttcttggtgagatcttcaatggtgtgcagatattcaatttcatttggcgtgacaaaggttacggatacccctttatgtccggcgcgtcccgtccgaccgatacggtgaacataggaatccggatcttgcgggatatcatagttgtaaacatgggtgacaccagaaatgtccaacccacgagcagcgacatcggttgcaaccagaaaatccaattggccgctcttgaactgccgcaaaacgctcattcgcttttgctgggttaaatcgccgtgaataccttcagcccgatagccgcgtgcctttaatccccgtgtcagttcgtcaacacgacgcttggtccgtccaaaaatcagtgccaagtccggatcctgaacgtcaaacagtcgtgtcatgacatcgaacttttcatagtccttggcccgaacataatattgctcaacggtatctgctgtcagttccttagccttaatcttgacaatcacaggttctttcatgaacttgttggttaagcgcatgatcgctgccggcatcgtcgcggagaacagtaatgtttgacgctcggtcggcatttgttcaacaatcttttcaatatcgtcaatgaagcccatatcgagcatttcatcggcttcatctaacaccaaggtatcaaggtgttccaactttaaggtatgacgaccaatatgatcaagaatccgaccaggtgtcccaaccacaatttgcggatggtcagcaagctgacgaatctggcggcgaatatcagcgccgccatagacagcctgaaccttgatcttcttgtcgcggcctaaacggtaaagctcttcttgggtctgaatcgccaattcccgagttggggaaatgaccaatgcttggatactccggtcggctttatcgatgtgttgcagaattggcaagccaaatgctgccgttttcccggtaccggtctgggcttgaccgatcacatctttgccttccagaaccagtgggatcgtctccgcttgaatcggcgtcgcttcctcaaaacctgactgggcgattgcctttaagagatcatgatccaaacctagttctttaaacttcaaatgagttcctccttgagaattcttgcacgcgtttacccaagcgtgttttcaagaaatccgcgggcgtcacgtgcattttcagtaaatgacaaaaaaacatatcccaacaatagtagcacgtccactatcgaaaaacaaggacggcgattgcgagatatgttaaccaggcacaggtaatgcccactttcatctattaaaagtagtaaaagcttttagtattttcaagaaaattaaacttactgatgcccctcaatatcttgttcaaagtccgattcacgcatgtccgcctgcgaccagcgcagccaaaacagtttccagatgcagaccatggctcgcttttagcaacaccatgtcatcgtgcccgacatcgttttgcaaatcgcgaatcatggtacttttggcatccagcgggtaatagtgtacttgatcttgcggatactttgtcgttaacgcttcggcaagtgcctgcatttccgaaccgtataagtaaacctcctgaatctcgtgcggatcaagtgcatcggctagtcccgcatgcaacgcccggctttgctcgccaagttcaagcatgtcacctaaaacagcaatgtggcgtcctgccgtctgaaactcgctaaaatcatggatgactgctttcatcgcagtggggttggcattgtaaacatcgctcagaatctgctcgccgacatcgccaattaaccattgcgtgcgattagccgtcacctgaaaatgcaccagtgctttttgcatggcttccggcttgacatggaaacgccgacctactagcaacgcagccaaagcattgaccacattgtattcacccataatagggattgaaaaggtcaattccggccactgttcgacggtaaattcggtatgattgcgatggccgctaatcgaatgggcaaaaagcgtattttccggatgtaaaccaaatgtttcttgcgattgggtaacttgcttagcgcggctcactaataatggttcgtcaccgttaaaaataaaggtgccatcctctttcaagccatccgtaatttccatcttggcatctgcaatcttagcgcgcgtcttgaaaaattcaatatgagcctcgccaatcatggtaatcactgccacatccggttcggccaacgatgacaatgcatgtaattggccaggccgatccattcccatctcaagcaccagcacttcggtattgggctccatactgagaatcgtcattgggacaccgatttcattattgtaattatccggcgtcttcacaacatggtattgcgttgccaaaatcgccgcagtcatgtcttttgtcgtggtcttcccattgctgccggtgatggcaacgactttagggttcaccttcattagcaaataatactgggctaacttctgcatggcggccagcggatccgggaccaccaatgttggcagtttagtcgtcattggcagatggtcctctgccacaaaagttgcgactgcccccgcagcagccgccgctggaataaactcgtgcccgtcacgctcgccacgcaatgggacaaataacattcccggcttcaatcgccgcgaatcaaatgccaccccggttgccacttgcgaaccgactgtttcagagagcggctgggcttttacgacacgtgcgatctctgccaatgtcattttcatcattaactcgactccaattcttcaacttcacctcgtttttcaacaagatgacaaacatttttcaatcaaaatcacggaacaatttgcaattacaacaggttcttcctgcctaaaaacacgaaactgccccgcaacaggcagtttctttagcgctcggttttttcttgatttctatcgggatctagcaaccattgattcttttgccgcattaaaactagcttaccgagtttacgcgccgtctcatccggaaaaataccatccggaataaaccgctcatgcagcgccagcaacggaatcgtgatccgttcacgcgaaaactgaacgtgacggaaatcaaacaccacaccatcttcaagtaaaggtagcagctgcgtatacgcaccgtgcgacaagtgtgaaaagtgttgttgtcgcagccgcaaccaaaatggctgttcattggcaattcgtcgtaagtatttattgatcgccgcagctaaaaaggcctcaaataagctttcatgccgtaaatacatattgaccgtgccattacgcatcggcaaataaaccagctcattttgcaatttatagtaaaacggtgagttcagatgcgttttcgcatgacctaagtatagcagttctgcgatctcattaggggtcagttcctgcaaaaaccgcgaacgcgaataatccaaccagcagcgggtttgcccttccttactacgcaaaaaatcccgtacttgatctttgccattgataacattaaaccaagtgtgcggatcaatctgttcctgttcattgacaggtggcaacaggagcaaatgttccggcagtttttgatggctattcagcaagtcactcgccgaaatcccataagtcaaaaacaaatgggctaatggttcatgatgaacataaatcagtgcattccgcatggttaaaaccccttaatactcccaccactattatacgactttcgcggctcttcattcatgcagtatgatgaatttaaagcgcacgtgacatcgacaaactgcactgttaggcaccggccctctctgcagctatgaaaacacgctaaaaatcgcacccatcacctaggtactggcgctaacaagaaaagaggaggttgcaacatgctgccatggccaaaaaagatcccacaacctaatttaccaacaattccagaaaccgacctcataccttcgacttatttttcaatcattcaaaatgggattttccctaaaaattggtggttgccgacatcggagccgacaagcgatggtttgaccggcgtcggccttcatgcactggcaacacccggtccggcaatcacctcagacgacctgccatcagactttttgccttttgcccacactgctcaccaatacttcggctttgatttgcatcatgaggttcgccgaatacgttacattgacaccgaagtcgatcaatggctgacggttgcgccggactttgatacgtttctcaagcgcctgcaaccgcgtccgattcagctacctgagctaccggtcgacccacagattttcggacacatggccgtgatggcaacggcttcagattggccggccttatttgatcacgcccgcgaatttatgtctggcgaaacactcggccaatggttaatgtggctagccgccagcgatgatccggctaaacgccaagctgccgcagaagagtaccgttttctcgtgcgctatcagcccaacttgcttacgcccaatgtcaccatgaacctgcaacatttattgcattaagtagcactaggcaactcatttatgccgagcttgatgcggttgaaaagcaaacgtcttcaaccagcttaagtcacgtttaatgccaaaatagccaaccaacgccaaccctaatgaacccagaaagtccatcaataaatcacccatcgtatccatgagcgcggcccgcccacgtaatagttcaccgccagcagccatatatcgctgcatgttcatacccagtaacccatcaaatgtaaactcataaaactcccacaataccccgatggttgtcccaaacgcaagggcaaataaagccatgagcaatggacttgtcgcggccaaccgttttgccggcgtcagcgctgtaaaaatagcaaagccaagcccagcaagcatcgccgcactgaataaatgctcaaacttatcccagtacggtacgctatagcattgcaatcctgtacccagtaaaacactcaagaggataaaaatttcaaataagtaaatcaaactcggcggaaaacggaaatgccaccagtgctccatcaaacgcggcaaactaacaattaagatgcctgatgccacctgagcaagtagcatcatctgaccatgaaacaaagaatgaccactaagataaagcccgccgacaatcagtaagtaaagtatatcgccaccgatgtttaaccaatacaaaaaattcgatcgtttagtcatcattttcctcttttctttgtgattgtgaaccagcttggttactcctggcacgcgcagaggcaacccgcgcttttgtttatgtctgtttccggctcccgcttccatcaatatggtggtcgggagtgcgccatttaagtcgtgggttttggctcaagagcaaactcgagaaacgaagcccgccattttctggcatcagtgcaattaatatgcttttgtaagcgcttggtgtagactcagctttaggaggtgattccatgccaatcaaaacgttacccgaagatcaacttattgccatgagccagtccgtcgtcaaagaagtcgccaaagcctttaactttccttattatgtcaatgatctgacgcatgatgcaaattttgacactgatcacactgcgaccaagctcgaatttgagctcaccttgttgaacgaccccgatccagagcgcaccatcagtttttacagtgacgccagcgccgatccaattatgggcggcgccgcttctgcacaagtgacgattctatctgatatcacgtttatttatctaaacgacgggtacaaggattcgtatctcattatcatccatgatggtaaggttgttcaaaatctcaaattagaacaacagattctgtcaggccccgaaattgaaaacttaatcaaccaagtcatcccacaagctcaatgaatcttagcgttaaaaaagcagctgaaaagctgtttttttgttatcctcggttttgttaaccacgtaaccttcagtttagccgcaaaaaaactttatcgaagcaaaatatacttctcggcagaattcacattttaacggccgatttagggaacccataaatattttatattaaaaatataatgcccacgctcaagactttgagaacacaaaaaaaccaccattaaaggtggaaaagtttgggggaacttttttgggagtgtaagttaatgtgtaagcttaaggctaaaatacctctgccttattgatttaagtatatcaattccttaatgatatgtaattccattttcaacaagaaatatgtttaataaataaaacggcttatgcttatataagttgaagctaacaaaaaagcaacctcaaaaggctgctttttttgcttatttcttgtcgaagccgtacttcttgttgaaacgatcaacccgaccatcagcctgcgtgaacttctgcttgccggtgtagaagggatgtgaatcagatgaaatttcaacccgaaccagcggatattctttgccatcttcccacttaatggtttcttttgaagttttggttgaacccgaaataaatttgaaaccagttgctgagtccataaatacaactagatgataatctggatggatgccttgcttcataatcaattactccttttgccctaaatcattgcctgatctagagatactctgactacaactctaacagtctatcacgcgcaaacagtaaacgcaatctcaatctactaattcaacatctgcacctaaaccacgtaatttcatcacaacccggtcatagccgcgcaagatattatcgaccttcgtaatcgttgtggtgccttcagccattagcccagcaatcatgagacacgcaccggcacggatttcctcggccgcaacttcggtcccttgaagatgatcgcagtggtgcaaaataatcacgtcattttcaatcgtaatgtcagcgcccatacgtaacagttccggtatatgccgaactcgtttgggataaatggtgtcgataatcaagccttcaccatgcgcttttaacataagtggcgtaatcggttgttgtaaatccgttgcgaatcccggatacggcattgttttaatttggaccattttcaagtcgccggatggatagacgaaaatgctatcctcgcccacatccatcaccacacccatttcttccaacttagccaaaaatgcatctaagtgttcggaaatgatgttcttaactttaacgccttcacctactgcagccgccatggctaagtaagtgcctgcttcaattcggtcgggaatgatcgtatgcgaattatgcgcctcaagcgttggcaccccatcaatgcgaataacgtccgtgccggcaccgcgaactttgccacccatattgttcaggtaggttgccaagtcgataatttccggctctttagcagcgttttcgatgaccgttcgtccttttgccgtcaccgccgccagaatgacattgatggtggcgccaactgaaaccatatccagaaaaatacgggcaccatgtaagccttcagccggcgctttaattgccatcgccccgtgttcattgctcactgaagcacccaacgcttcaaatcccttaatatgctgatcaataggccgcggaccgatatcatcgccaccaggcagcccaacaattgctttgccaaagcgccctaataacgcgcccataaaataataggaggcgcgcagactcttaatcttaccgtttggcagcggcacatcattaatttcggttggatcaattgtcagaacattttcggtaaaatccgatttaacattcatatcactcagaatcgccatcaaattatagacatcctgaatatgcggcactgaatcaagtgtcaccggggtgcgcgacaaaattgcagccggaatcaaagcaaccgtgctgttctttgcaccgccgatcacaacttcaccggataatttctttccgccgtggatcagcattttttccatttgaattaaatcctcacttaaggtcgttcatttcaagtaggctgaagctgacctgcattttatgcttcaaatatcaatcacgaacactggtaggcaagccatgacccattcgccatgcactcaatatacaagtttaatgaatcagcacgcaaaaaacaaggactaaaagttagtgagcgcgaaccggcgcgcttagggatcggagtgtaagcggcctcaaccatgatgccccttttgccatcgccttcgagccactcacacgcagaccccttgcaactctgagcgcattacgaaaatgcataaattgacctccgccacaatcccacccccaaatacaaaaacagcctcaaggactgaacctcaaggcagttttcaaacgcaaaaatactaatttttaaaatcgccagctgattggatgaaggctttgaacagtccttctggcttgtttggccgtgattggaactctggatggtactgtgaggcaacgaagaacttattcttcggatactcaatgatttccatcaaacggtcgtccgggctaacccctgaaaagaccaagcctttctcctccattggcttacggtacttggtgttgaactcataacgatgacgatgacgtttctcgatttcatgagcattgtcataagcctttgctgcgacggatcccggctttaagacacatggataaaggccaagccgcagtgttccgccaagattcttcacgccaacctgatcacgcattaaatcaatgaccggatccttgacatcaggatgtgtctcggttgttccagcatctttgagtcctaagacattacgtgcaaactcaatcgaagccatttgcatacccaagcagatgcccaggaacggaatatcattctcccgtgcgtaacgaatggccgcaatcttgccttctaatccgcgatcgccaaaaccaccgggaaccaaaatgccatcaaaaccttgtaacagactttctacattgtcatcattaacgtcttcagcctgaaacatctgcaagtcgatatcagaatcccagtagtaaccagcatgcttaagtgcttcggcaactgagatataggcatctttcaacgcaacatacttaccaaccaaggcaatcttggtttgatgcgtgaggtgctgaaccttatgctcaagcttagtccaatcagtcatatcggctggtgggacatcaaagccaaagtggtcgacgacgatctgatccatcttttgggcttgcagggctaacggaattgaataaagggtcttggcatcgcgtgattcaatgacagcattttccggcacatcagtgaacaacgcaattttcttcttcatctcttctgtaatcggtttttcggttcgtacgactagcatgttgggctggatcccgatactgcgcaattctttgacgctatgctgagtcggcttggttttcatttcatctgccgcgcgcaagtatggtaccaagcttgcgtggatatagaaaacattttccgaaccaacatcacgtttcatttggcgaattgcttcaagaaatggcaaggattcaatgtccccgacagtgccgccgatttcggtgataatgacatcggaatcgctatgcttggcagcgcgcataaccttttccttaatcatgttggtgatgtgggggatgacctgaaccgttgcgccgagatattcaccgcggcgttcgcgttgcaggacttcagaataaattttcccggttgtgacattgctgtacttgttcaggttaatatcaataaaccgctcataatggccaaggtcgaggtcagtctcagcaccatcatcggtgacaaacacttcaccatgctgataagggttcatggtgcctgggtcaacgttgatatatggatcaaatttttgaatcgtaatcttcaaaccgcgattctttaacaaacgacccagggatgcagcaacaatccctttacctaatgacgatacgaccccaccggtaacaaaaatatacttggtcatagccagtctcctttttaaattaatcgggaaaaacaaaaacaagctccctgttcatacgaacagggagcttgaaccgtattggctttacacttctgtaaagcgcccaaaatgtatattaaccaattgtacgagatccgtcaagcattaatgaaaaaaagtaagtatcaaaaccatgaacgaaaaactcaaacctaactgaataaaaggatacgtcaggtcaacgatgctccatcagtgaattttatcagtctcctgaggcccatgtccatcatctcgactgaagtttggtcaaaacacgctcactctttcactcactttcctacaaatatatgagcctaacatttgtgaatagcaataagattgttacaataaggttgtggtcaattgaacgcatgtaaaaacaattttgtaaatgaggaagtggtaaatcaatggcagatgttgtcattttaggtgccggatatgcgggcattcgggccgttaaaactttgagtaagctcgcgccaaaaggaacgacgctcacagtggttgaccaaaacgccaatcatgaagagcgcacacagcttcatgaagtagcagcaggtaccgtgcctgcaacgaaaattacatttaatatccagcaggttcttcccaaagatgttcagtttatccagtcaaaggtcagcaaggttgacgtgtcgagcaagctagtggtactggaaaatcatgcgccgctgcgttacgactatctcattatcgcgctcggctttcgctctgaagactttgggctacctggcgccgcagaaaacgccttgccactggacaatgtgacctccgccgaaacgattgccaagacaattgaacagcgtgtcgccaattacaagcagtcacaagatcccaaagacttaacggttattgtcgcaggcgcagggttcactggggttgaattattaggcgaattgacacatagtctaccggcattagccaaaaagtatgatacgccacctgtcaaaatcatctccatggaaatggcaacgcgtattttgccgatgttcgatgaaaagttagcaaattatgcaatggattatctaaagagccatggcgttacgatgatgaccggttccaagattaccaaaatcgaacctaatgccgttgtttatgctgacggcgatcaggaaaagaaggtcgaaggcaacacgatcatctggacagtcggtgtttcaggcagcgatgtgatcgccgattccggcttcaaccaacgccgcaatcgcgtagttgtttccaatcacctgaatctaaccgaccatcctgaagtcttcatcatcggggatgtatcggcagtgatgacagacgctggccgaccttatccaaccacggcgcaaatctcctcccaagaaggcgatcacgccggcaagaatgtcgccgcagcactaaacggtcaaccgttaacggactttgtttacaaacctaagggcactgtggcatcgcttggcagtcaagacggtatcgcccaaatcggcaagagccacaagtacaccggcttcattgccaaggtgctcaagcgtgtgatcacagataagtcactgcttgaagacgccaatttgagcacgatgttaaagcaaggacgttggccgctttaaacgttccggtaaaagcaacaagcacgtactaggtcaatgatgatcacaaaaaagcagcgaatatcgctgcttttttgatgcttaaaggtatggtattaagtcattccccttgatttgcatttctatcgttttggttaacggcttcctccatcttgcggacagcatggttatattcagtaatgagtaacctgatgtcaatggaatcaaccttagattcattatgcggaagtggtatggttgtgacttgaatccgcagcggcagatttgattgttcaaaaaaatcggatagtgctgaaagaaattggagtgcatgcatgagattgccataggatgaaagatgattaatagtcaagaagatataattttcaatttcttctttttctagcaattctgacaccttacatgcttcagcaaagttattgatggctctatcaaaatatgtcatagcgttcctcccactaatagcggctaattaaaaacaatcttagaagccgaatcgttttccaccgtttgcatttctattagtttgattgacagccttctcaagcttttgaacggcatgacgatactcagacttgagcagctttgtgacaatgaagtcgaccttagattcattcccggaaagtggtatttgcgtaacctgaatttgcagcggcagacttagctgttcaaggaaaccggccattgctgaaagaaaaattagcgcatgcataaggttgttgtaggatgaaaggcctctaatcttaaagaaaacaaagtcatcattctcgtctttttctagaagatctgaaacctgatatgttttcgcaaaaaagtcgatagttttatcaaaatatgtcatgaaaaatctccgcaatcatggtgactgaacgttaacgatcctagaaactggttccaacgtcagggataacactcaataagcatcccgctgaatgtacagcttgccccgacaagccggcatcgccaacattcctttattcgtttcaacaatacccaaaatttcacctatccaaagattaaataaataattatttcaagtataccaattgtgttttttacgtcaacgattttgaaaattttccaatgctgctcatgaacgccttgaatctggtcgtctaggcgtcttattgcggtaatctttatttttgctttgccgaaatgccgtaaaccactgatcaagtattgccggatcaattttcaattcctgttgcgcagtacggctaaacttttcccaagcagccttgtttgccgcttggtcgccatgagcactgcgtaaatcgcgaatgtattcacctacaagtcgccggaatcgcatctgctgatctcgattcatcttcaagtaattccgttgccctgttgtcgccatctgctgcataccggtgagttcgcgggcatcgctgtcgattgtaaaaaatgagcggattggaatggcaatgtacaaaatataagcagctttaggtaaaaataccgccagcaccataattgcggcaatcatcaagaaattttccaagttgtgggcgccgtaaatgctcgtgtagatttgttgcatttcggccttattactagcttgctgatgcacaatcgttcgtgaaataatgcgaaaaacggtaatcactaaaagatacagtgcaccataaataaccaccgaaagcacttcaacgtcaccagacatcaagcgcgtcaatgccggtaccagcgaaagtaggaaaactaaaataaattcccagatgacaattcgccgcgggatttgtttgacctgactaaacaaagtcgcttgctgataccaaatatttgctacaaaacagaaactaactgcataaatgccaaccgctagaaaaaactcgctgatatgtgtatgattttgccaactctccgccggcaattccaaaaccatgatcgtaataataatagcaagaatagcatcgataaacgtatccagacgggttttaagatcctctgaaatcataaatagcctcctgagtgtgtgccagcgtacttagaatcgaagtgtaagcgagccatcagcttggatcattgtggctgaggccctcacacgcaaatttctgcgctgggaaacgcatcatgataagcgtgagtcattacactatgatggcagtatcagcttttcaggaaaaatgtcaagctcgtgaaaacaaaaaagccacaccttaaaaagtgtgaccgttaaaccattaatgtttatcgttgtcgtcttcatcgtcagcatcatcgctgtcatcatcgtcatcgccggagaagtcagctgtgatgtcatcggtgtcgtcatcttcgtcgctgtcattgtcgccaaattcagctagctgaccttcaatgccatcgggaagtccatcatcaggatcatcatcgctgtcatcgtcactatcgccggccttgccgatcttgtcatgaaagccagtgctgtcatcatcatcgaaatcatcgtcatcgctatcagcgtcgagatcttcatcttcaggatcatcgtcgttgtaatcgatcacgtcatcgtcatcggcaacatccgccaagaacgcattaactttcttacgtttcttgcgacgtggcacttcttcttcgtcttccggatggttaacttcttcatcaacggaatcgtatggataccaagcgcgcaggccccaaacgttatcgcctaaagaaatgaagctgccatccacattgagatccgtatagaattgcggcaaacgttcacgaatctcttcgtcactcttaccgagataattctggatctcattggccagatcaacgaacgccatggtatcccctttttcttcgaggatctcatgggctacttcgatcattgataattctgatttatcggcattggcaaatgctttgagtttcaaccgatacacgccctttccacagtctttacagtctgttttctatcatacccgctcaggccttaaattgcaatcgcaaccgataatttcctaaatgttggcgattggcaaaaagctcatactcaacataaatttcacccgcaaccggttccgtggtcattcgcacatcgatccgaggtgtcaccgtttcaaccggaataataccgtatggcgtccgatagcgggtcaaaacccgtttttcatccgcaaaaaacagtttcaactgagtatcgccattactactgccacgcgaaagttgaatatcaccgtcttcgcgcagtttcatcgtgaccggcatgctcgttcctgcatcctcgtccacttcctgatagcgaatataaagtgcgttccccatctgtaccaacgttccgggttcatcaaaaacatgtgtctcctgatcatcaccttgcgtcacaaacgtttcaaggtgaatctgaatcggcactccttgtgaaagatccataatgtcaatcctttctatagagtattgtacgctcacaggtcaagagggtcgagtacagagcgtgagtgagcgcgagccggcgcggttagggatcggagtgtaagtggcctcaggtgcgatggcccgctcttggccattgcgcctgaggtccttacacgcagatccctgcgccggggagcgcgttatgggcataaaagagaactcgcgcccaaaaccttacacgccagactcccgcacccccaaacacctttatcccaatgaaaatggctttgtgcctgacgtgttcggttaccttcgctataatataggtaatctattattatgaaagaaggcgcacaatggacttaacgtcactggctggtcagcaagcagccatcttccagcaagacttcaccaaagatgaggcgccgctcagctttgcccacaccaatgcgttattagcccatcccgagctccatccaccgctgatgctgcatttctggacggctgaacaaaccgtcattcttggtatgcaagatttaaagttaccacaattggggcatgggctgccagtcctgagcagcgaacaatatggcgtctttgtccgcaattccggtgggctagcggtgattgccgacagcggcgttttgaatgtctcgctttttttacccaatgaaacgcgcctgaccatcgatactgcttatgagcttatgacgtcactatttcggaccgcatttccagcgctgaaaattgccaccagtgaaatcacgcattcctattgtcccggcaaatacgatttgagtgtcggcggccaaaaattcgccggcatggcccagcgccggaatcaggccggggtggtcgtgatgctttattgcagcattttcggtgatcaaaatgcccgctgcgatttactacgtcgattttatcgggctgggcatgccagcgccagtccccattttacttttccgcttatccgttcagaaacgatgaccacccttagcgatttacttgatcggccactgacgcgtaatgaggcgattcttgccatattgaatgccttagcaacttacggcatcgcagccgacatgaactcgatgccggcaatattgcgcgatcctgcttaccatcaagcgctcgctgcagccaccgccgatttacgtacacgcaatcgcaacttaaaaaagatgggagaacatcatgcaatttgaaaaattaccacgggaaaaagtttttcgcgatccggttcataattatgttcacgtccaacaccgcgtgattcttgatttaatcaataccccggagtttcagcggttgcggcgaatcaaacaactaggggtctcggattatgtctttcaaggagctgagcatacgcgctttgcccactcacttggggtttatgaaattgcgcgggagatgtgcgacaattttgtcattaactatcccagtcaaacgcctggtgatggcctttggaatgacgctgaacgtccggttgtcctgtgtgctgcactgttgcatgatattggccacggcgcatactcacatacgtttgagcatattttcgggacagatcatgaggcaattacccgcgctattctcacggatccgcataccaatgttaaccgtatcctgcgcggtgtgagtgcggaatttcccgagcaggtggcttcagtgatcaaccatacttatcccaatccgcaagtcgtccagatgatttccagtcaaattgacgccgaccgaatggattacttgctgcatgatgcctactataccggcaccaaatacgggctttttgatctttctagaatcttgcgggtgatgcgaccttattctgatggtatcgcttatgaagccaacgggatgcatgcggtagaagactatgttgtcagccgctttcagatgtatcaacaagtctattttcaccccgtatcccgcggcatggaggtcattctcttccacctactaaaacgggctaagtttctgtatgagtccggacagtttgaacccgggttttcaccacgcttactggtgccctttttcgagcaatcctttagcttaagcgactacctcaagttagatgacggtgtgctcaacacctactttacgtactggttagattatcccgacagtatcttaagcgactttgcggatcgcttcttgaatcgccgcccactgaaatcagtgacatttaccgatcaaacggccgcgctgcttccaaaactacgcgcgttggtggctcaagccgggtttgatccgcaatattacaccgccgaaaatgatagtttcgacttgccatatgatcaatatgatcctgcctcagcgaacccgaaaactcaaatcgaaatcatgcaaaaagacggcactttagaggaactgtcaaccttatcaccattggttgctgcgctgagtggtcgggcaacaggcgataaacggttttattttccaaaagaaatgctcgcctctgaagatagcagcctcttttcacctatctatgaaaagttccaacgttatctgctcaacggtggtgtgattgatccacacttaacggattagcaaggtgggcttcactgtttgggttgctgggcgagccacttagccacggcccagcgatgcgtcggccgtttcaattcggccaaggccagatcgatcggcatgagcatcaatgtattgaaggtttcaagcggatcctgtacaaaagccagttcatcacaggcaaaaaacgtcgccggatggtaataggcggtttgacgatgatgggaataaaaatactcagacgatttgccgagctttttggtcacatgcacggttgccccaaattcttccaacaactcccgtgccagcgtttcttcgggagtttcgcctttttcaacgccgcctcccggtaaaaacaacgcatgattcggcgcttgcaaaatcagcaaccgcgcgccgctatgatccggaatgacgccatacgcgccaattcgggtgtgataatctaactttggatcttttcgaccaaacacaggatcaatcatattgcatccctccgcttttaatcacattataccctaatcaatttctaacctctacacaaggagacttttcgatgtcagctcaggaaacgttatttgtctttaccatcccccttttgctgggaattatttttgctatcagcttcaccattgaaccgcggcgtttgcttaacggctggctgttcaacttattcgccgtggtatttttgatcgctttggcagccgcgattctaaaatccggtaacctactacttattgctgtaaccggaacgctttttgtgattacggtcttaattgtgttcttgctgtttgccttgcacttattttggctgctatggaatgctatccttgtgtggcagcgtgaaggccattcgttaagtaacatgttgacgctttatattgccatcggactgttgttgttggaaattgctgcttcgtttggccgccgttttattcccgaacctttatacgtcgccttggcagtcttctttggcttaggtgggttatatgtcttattaacgctttataacttcttgaccgcgttaatcctgtacaatctccggccacaaccgcataatcgaacttttctcatcgtgcttggcgccggactactgcacggtgatcaagtgtcaccgttacttgccagtcgcattgatacggctattaagttttatcacaagcaattaaaaaaaggccgccccgctccaaaaattattttttccgggggtaaaggcgcagatgaggctatttccgaagcactcgccatgcagcgttacgctttgggaaaagggattcccgaggccgataccttactcgaagatcagtcaactaccacccttgaaaatatgcggttttcaaaacggttgatcatccaagagattggagaagctccttataaagccagcttctttaccaacaactatcacttgcttcgagcgggcattttcgcgcggatggcgggtattgctgctaatggcgtcggcggtaatacatccttttattttctgcctaatgcggttattcgtgaatatctggccttggtggttttgtacaaacgccggcatgccgtggctttcggtgtgattgttctgatcgcgctagggcaattcatccgggcctggcaattgggttgagcgcttaacgtgcagagtaggtggcaatttcggtacactaactatacgagggggttatgttgatgttaaaagaattccgtcaattcatcatgcggggcaacgttttggacttagctgtcggggtgattatcggtagtgcctttaccggtctggttacctccttgactaagaacctgattaacccgattttatcaatctttgccggtaaaaccgatcttagcggtttatccattacgttattaggcgccaaatttacatacggcaattttcttaacgatgtgattaactttttgattatcgcctttgttgttttcatgattgttcgcagtgtcaatcgtttcttgcccgccaagccgaccaaagccgccgggcccacccaagcagaattgctcacggagattcgcgatttattaaaggagaagaacgaccattcgcaggtttaattgattaaaaaagtcaataaaaatcaaatggctcaaggaagacgcagcagcgttatccttgagccatttctgtttattcccatcatttatgaaccttcaataacctgctgcgaaaacaactcagaaaccgtccgcatagcattttttacggccactgtcgcaagtggatcctgtgccatgcttgctgaagttgtctgaagccaagcgccagagtccatagtatgggtgccgtcaagattagcaatacctgaaacacaaatttgacaatcacaacgccaatagtgtcaatgccgccgctttctaggattgttgccatcaccggtgtcgtcgcgtaaataaagtcttgataaagattcatattctttttcatgtcagctacataatctttgattgaacggccagtagaagcaaatcgttgggcgctgtggtcaatttgatcaaggtagcgcggggccaggaccagccagctgatcaataagtaaccatcaccgattgtgggcgtgaaatcgaacccacttgttttcttaaggtgaaagaaaaggattaacaagccatacgctgcaatgagtctcagtcgtttgtgcataccagccaccccacacatcacctaatcaagttaccgggtcctatctgaatgctgatatcataagccgaacaatcacttttgtatagggttagcccaaatgaattgccaaaacgccatattttttctcttgttgcggcgtataaatgcgataggtgtcagcgaccattttagccacggaatcggttggtgcacttcccacggcggtaccctgatattgctgataaagctgggaaaaggttccgaacttttcaagctgagtaactttcttggtaacttgttgctgagtggcgagatcctcaaacacaatttgatcatcaacctttagctgttggcgcttttcgtcattgaggcgaatctctatcgtcttagttcctgcttgcaccaacagaaactgatcatgcgcaagtcccatttccatgccatttttctccttgtcattacgttgctaaatccccaggccaaacctaaaccatcaaaaaagcacaccttacagtgaaggtgcgcaaacttgatgttacttggtgaatcgattttcgaataatggagtcacggatcggttttcctgaatccgcatgattgcacgtcccattaatgggccaacagaaacaacatctaacttatccatgtgtttatcggctggcaagttaatggagtccgttacgaccaccttttcgatggccgagtgggtcaaccgttcaactgccgggccggagaagattgcgtgggtggctgcgaccaagacttcggttgcaccggcatctttcagcgcttgggctgcaagggtgatggtgcccgcggtgtcgatcatgtcgtcaataatgatacattgtttaccggtaacattgccgacgatgttcataacttcagcaacgtttggccgtggccgccgcttgtcgataattgcaatcggcgccttgagaaattctgctaatttacgcgcccgggttacaccaccgtgatcaggcgaaaccacaaccgtatcagcgccgtcataatggttgcgtaagaagtagtcggctaacaatggtgcaccgacaagatggtcaaccggaatgtcgaagaagccctgaatctgggcagcatgtaaatcaagcgctaagacccgggtggcaccggcacgttcaagcatgttggcaaccagtttagcagtaatcggttcccgtgaccgcgctttgcgatcctgacgtgcatagccataatacggcatcacgacattaatcgtatgtgccgaggcccgccgtaaagcatcaatcataatcaatagttccatcagattgtcgttaaccggactggacgtggactgaatcagatacacatcatcgccacgaatactttcttcgatgttgatttgaatttcaccatcgctaaaccgcttcactgacgactttcctagttgcacaccaacctcggcagcaatcttctctgccagtggtttgttcgaattcaaggcaaaaatctttaatctcgggtcaccgtattgctcagacatatgttcctccacgaaatattataggctgcgaataattgttccacaaaaatcttagcggattgacgaaaaaaagcaagcatataaaacgaattataacctaattccaatctggatcgttcgcgagcggcagtcgtttccagtaatcttctttggtcgtttgacgcgcacgggcaatcgccattgcgtgaaacggtacatctttcgtaatcgtcgaacccgccgcaatgaaactatgatccgccacttcaactggggccacgatgttagagttagaaccgataaaggcatggtcgccaatcgtactattccatttttgaacgccatcatagttaacaaacacaacgccgcaacccacattaatatcgctgcccaaggttgcattaccgacatacgtcaagtgaccgactttggtgcgtgcaccgatcttggcttttttaatctctacaaagttaccaagatgaacgtattcgccaatgtctgcgtctggccgcaaatgtgaattggggccgatatcactgtgtgcgtgcatcaccgcgtgttcgatggtggaacttgtcacggtaacatcatcttccagcgtagcatccactagttctgaatgggtaccaatgtggcaatcttcaccaatcacggttttacctttcaaatagacgcctggttcaatcacggtgtcggcaccgattttcacatccgtatcaatgtaagtcgttgccggatcaatcaacgtgacgccattacgcatatgctgctcgttgatacgctgctgcatgagccgggttgcttgtgccaatgcaacccgatcgttaacgcccagagattcggtgtaatccggcatttgataagcagcaaccttttcaccggctgcccgtaaaatgcctaagacatctggtagataatactcgccttgtgcattgtcgttcttaacctggtgcagcgctttgaataacgcctgattatcaaaaacataaaccccggtgttgatctcggaaatcaatgcttcttccggagtagcgtctttttgttctacatttttaatgacattaccgtcagtatcgcgaataatccgaccatagccagtaggatccggggcattggcagtcaaaatggttgccttggcgcctttagcttcatgataagcaaacagatcattgagagtcttagccgtaaacaaaggcgtatccccgctcataatcagcgtggagccttccttttgccccaacaatggctctgcttgtaataccgcgtgaccggtgcccaactgttccgcctgcaacacgaattcagtccgctttccaagtgtcttttcaacttcttcggcaccatggccaacaatggtcacgatagcgtcaggatgaatggcttccacctggctcaccacatgctcgaccatgctcttaccacagaccggttgcaaaaccttataatacttcgatttcatccgcgtccccttaccggccgcgagaatgatggtgaatttctttgacatatgaatactccattcctaattatcttatttcataatagcccagccagccgatactgacaacaactgagcgcgagccggcgcggttagaagtcggagtgtaagcggcctaaaacgtgatggcccgctcttggccattgcgttttaggtccttacacgcagacttctgcgccggtgagcgcgttatgggcgtaagagagaattcatggcctcaggcgtgatggtcggactttgaccattgcgcctgaggtccttacacgcaggtttctggccctgtgagcgcgttatgggcgtaaaggtggatgtacgtccgtcctaaaacgtgatggccctggctttgaccattgcgcctaaggtccttatacgcagattcctgcgccggtgagcgcgttatgggcgtaaaggtggatgtaccctaaaacgtgatgcccgcgccaggtccttccccacaaactcctaccctctcccaaaacccaaccaaaacaaaaaacaggcccgtcgacatcccaagcctgttttccaaatactattcattcgacctgtcatgctcttcatccacatccggtttcgcatcgtcaacctgctgcttaacctccgctggcacttcaaacgtactaacttgagtcgtatcagcccacgcatcataaaagaagcgaaaatgccgcgagcccacttcccaaacaaaattaatcatgaacagaaagaccaaaaccgcaaagaatcctagcgcagccaaattaatctgagttcgttgaaacttggcaaaatacgcaataaagaaattgttcaaccctaccaagctggaaaaggccaggccatataacagtccttcgcgcaacaaaagccgccaaaatccgacagcttgaccatcagtacgcacaattttaatgcgcaccaatccttttccaagtgtctggccgttgttaaaggcaggccaaatgacgaagacaaaaaatagcggcaaaactgcctcgctcaaaaagtccggcaattgatccaaccctaacaaatgaaacaggaatttgatcataagaccgacaatttggctgaataagacaaaatcgactaaaaaagcggctaatcgtcgggcaaaagtcacccgcgcaccacgagcctgacttttagcgtcaatggtatcgcgggatggcaacgctcgcatcagaatcggcgccagcaccccgccaaccaatccacctgtcgtgttaagaatcaaatcatccacatcaaagagtcgataaggccgcggataaaagccatataacccggacagctgtgtcagctcaaagaataaactcaacccaaaactcatcacaatgatctgcggtacgctgcgtttaaagtagtaccgcaaataaaagccaaatggaatcgtcaaaacgatattaaagaaaggttgaatgaaactggactgcttgagcgcggccagccaggtgtgaggattgctcggcacaaagacggtcgtatgaatgaaataccgcagtgccattagcggcgtcagattatacttcgccccggtaaactgtgcgacagcctcacgagccggcaatggcaaaatgatcagaaaataagccgacagcagataaaatacaaacgaataaatgacaatcgcccgccaccagctaaacgcaccgtaacgtcgataaacaaccacaagaaacggtagcgcaagcagcagcgctaaaaacggaaatgtgattactgctgttctaaccggtccaaggtaagcactcattgatgactcacctcaagtaactgccgattctggctaagaaaattaccggctgtggcatgcagcgtatttgcctttgtatccactttatcaacgcgaataagcgaagtgtaatcgttcaccatgcgatcgccgtcaaacttgccctcagcaaaaaccgtaattccgaccatttttgcgttaaactcatcaatcaacgccttcatgccgttaacggtgccgccgcctttcatgaagtcatcgacaatcaagacccgcgaattagccggcagactgcgcttactcaactccattttttcaatccgagccgaggatccggaaacgtaattaaccgaaaccgtcgaaccttccgtgattttggaatcgcgacgcacaataacaaacggcacattcagatattgactgacactttgcgcaatcggaatgcctttagtggctaccgtcatgaccgcatccacattggcttcgcgatactgggtcgcaatcagccgcccgatttgacgtagaacactcggtgtaccaagtaagtccgagagatacacataaccgcctggcaacagtcgatcagtctcggaaagtcgcttagccatggccgcaatgaaattttccgcctcatcttcacccatgattgggatataacgaaccccaccagcggcaccgggcacggtttcaaggatgccggtttgtcgctgggcaaaagtccggcgtacgatagccaaatcctcactaatagatgacttggcactttcatagcgttttgagaaaaaagtcaacggtatcagtgtgtgtggccgttccaacaagtaccgtgtcatatcgattaatcgatcgctgcgtctaactttcattattccgctcctaactccgaatatttagctctgtattaacattgtgggataatcttatccagtataaatgcttttaacgaaaatttcgacccttttacgacaaattctcaccgaacgttcgcatttgtccctagttcactcagataatttttaagtcgtctcagtagccttgtattcatttctatattagaatggttacaaagaggggtggagaaatcatcatgaactgttttgaattacatcatatgacctttgcaccaacgcaaaccgctattttaaacgacatcaatctggatattccttgggggattgatctgaccattgcaggccattcgggttctggtaaaagcaccttgttgcgattgttggcgaccttattgacgccaactaacggaaccattctatacaacggtaaagcccaagccgactacgatccgattgcttatcggcgtgaagtttcttactgcgcccagcagccggcattatttggcgccacggttgctgacgatctgcggtttccatttatgattcgcaacactgaaatgccacgcgaacaagccgaagccgcgcttgaaagtgtcgatttggctaaaagtatgctcgatgcgccaacgcaaaacttatccggtggtgaacgccaacgagtcgctttgttgcggcatcttttcttcccgcctaaagtgctgcttttagacgaggtcacaaccggactcgacccggatactaaaacgattattcatgaacttctgaatcgccaaaatgaaaaaggcatcacgttgattcgtgtgacgcatgatgaaggtgaactgcagaccgccaagaatctcatgacgctggttgccggtcaatttgaggaggttgccaaggtatgaatagtcagttaatcgtttcgccgttagcacttttgctagctttggcgctagttgtgattgcattggtcattaacctcaaagaagatctgggcatgaccaaggatctgatcgtaggggttctacgcgcggtcatccagctaacggttgtcgggtttgttttgacctatattattaaagcggatgccgtttggctgactttagccatggtagccatcatcattttcaacgctgcctggaatgccaaaaaacgtgccggcaccattcctgatgcgtttgtcaccagcctgttagccgtcaccactgcaacagggttaacgctgctcatgttagtgtcggtaaaggccattcggtttattccggcacagattgttccgatcagtgggatgattgccagcaacgtcatggtcgcgatcggtttagcctaccgcagcctcaacaccgaatttaaagacttgcggccacaagtacttgaacgccttgcattgggcgccaacctcaaacaagccagtcagacgctcatcgtcaatgccatcaaaaccgggatggcgccaacgattgattcggctaaaaccgttgggctcgttagtttaccgggaatgatgtccggcttgatttttgccggtatcgatcctaccaaagccattatgtatcagatcatggtaaccttcatgctgctaggcgccaccagccttggtagttttatcgcggtctatcgcagttacccccgcttttataatgatcaaaagcaattacgttagcggccttgtcctccgaaaataaaaagtttctgcagaagcgaatctttttgcctctgcagcaacttttttggtttttatgcattttcacagactagtcagtaaggattttccatcttgttatccggtaaatacggcccatattcaacttgaatcgtggtgtgggcaatgtcaaagctttctcgcaacgataaactcagtgcgtccaagaaggcgtcattgccttcagcagttgttcgcaccacatgtaccgtcaacgcgacatcagttgtactcagcgcccagatgtgcaggtcatggcaagatgcaacggttggataggcgttaaccaatgttttaaccgccactggatcgatttccttaggcaccgcggccattgctaaattaacggcatcccgcaataaatcccaagtcccgatcaaaaccacaattgcaactaaaatggacatgaccggatcaagccattcccagccagtcagcaggatcaatcccccggctaaaacaactcccagcgacacgccagcatcggcagccatgtgcataaacgcaccacgaatgttcaaatcatgttgcgagccgctatgaaaaagaattgcagttgcgccattgaccaaaatcccggcaccagcgacgaccatcatccagccgccttcaaccggagcattttgtgacaatcgggtaatcgcctcgacaataatcgcacccatcgccaccagtaaaaatgccgcatttgctaacgccgctaaaatggacgaactcttatacccgtatgtacgctggacggtcgggtgccgattggaaagccactccgcaaaccacgctaagcccaagcctaggacgtcgctcatattatgaatggcatcggcgaccaacgcgaccgagccaatcccgatcccaaaagcaacctcggcaataatgtaaatcaaattaagcagaataccccagaaaaaggccttgtttggctgaacttgttccatcttatcatcagctcctcagtttccttttccatcatggtttagtgctacctaaaaatcaacccctcagccgatgactattcgttgacaggcaaaatggccgcaacagataaacctcacgacaaaatcccttcatactgttgtaaacccgcattgcccgagaatgcttctgacaaagaccaaacaccgttggaccgctacctgacatttgagcgatttcagcgccgtacttttttagccgctgtttcaatgcggtcatttcaggataacgacttgccgtaatggcctctaaactattccccattccgctaatcatttgggcgaaatcatggttttgaatcccggaaacgacttcaggtgtatttgggtgcaaaaggccggcctgatagtcaattgcattaagaatacttggcgttgacactgacacccgcggcttagccaaaacaacccaaaagttcggtaaacttcccaatggcgtgaccacatcgccgcgtccggtaaccaaggccgtctccgagtaaacgcagtaaggcacatcgctatcaacctgtaagccgatgcgagccagctgcgagcgactataacctaactgcaatagtgaatttaagccccgcaaaacggcagctgcatcactcgaaccaccgcccaaacctgcagcgacgggaatgtgtttttcaatatgaatccgcgcaccttggcggatattggcatggcgttggagcgccaatgccgctttataggccagatttcgcggatcttcaggtaaaaaaccgctatctgtggaaacctgaatgctatggctaggcttaatgctcacgtaatcagccaaatcaactgatgtcatcaccatctgccactcatgttcgccgtcagcatgacgatacaaagcatccaaacttagattaatcttggccggcgctttctcgatcagttccatctaaccaccagtctctggcgatgcatgtatttacagggagagctcacactgcaaacgacgatgcatgcatccgccgtatcgttattttcagtatactgttttgcgtccggattttcattgccgcgtgtcaaaaattcgtcaccttgtacagatcagtctttcaagaagatagcaaaaggcctcgatgccaatgacatcgaggcctgctcaaaataaacgatttaatcgtcggttagtatctgaaattatgacgctttttcttcgccttcgaaggtgatcttgattgacttagtcagaagatccgcgtaactataagagacacgctcgaacgcattttcattctggtcgagatcgaccacaaaaatagccggataagtttccttcaaggtcccccgacgccgagtaaccttcttgcgtcctgcttgtgcaacgaccgttaaattctcaccgattttcccatcgagcttccgtttgatgcttgctagtgtgattggcatgcacttcacctcttgaaatacatcataacacgaatgcaagaaatttgcaattataccatgtgtttcttatttcggcaagatttttataaggagtgagcgcgagccggcgcggttagaagccggagcataagtggccttgggcgtgatggccgggttttggccattgcgcccaaggtccttatgtgcaggcttctgcgccggggagcgcgttatgggcataaaggagaacttgcgtgatgccccgctcttgaacattgcgctcaaggtccttacacgcagactcctgcgccggggagcgcgttatggacctaaagttgggctcgcagccttaactgtgacaacccgctatcccgcaatgcccaagccttcaccccgcaacgcttcatccaaccgtgcaaaatccgcaatcgccaactgttctgcccgcgtctccggtgcaatctccgccaccgagagcgccgtacgaatagcgtccttattcggtttaccaaacaaagccactagattattccaaagcgttttacgccgagacgcaaacgccccacggacaagccggtcaaaactttctggactttgtacggtcgccaacggttctgagcgctgggtcaacgtaacaatggccgaatccacatttggtgccggaacaaacgcgtgccggctgacggtaaaagctgtcgccacatctgccaccagttgcacggcaatacttaaactgccataatccttcgatccaggcactgcacttaatcgcgctgccacttctttttgcatcatcacggtcatgctgtgcagtggtaaatgtgctcgcaacaagtgcagtaaaatcggcgttgtaatgtaataaggcaagttagcaacgacttttagcgtgtggttcccatcaaaatgcgtcgctaccagctcggtcaaatttgtttttaaaacatcctcattgaccacggttgtattaggataatccgcaagtgtctccgcgagaatcggcagcagacgatcgtcaatttccaatgccaccacctgatgcgcctgatcagccagaaactgcgtcagtgcaccaattccgggaccgatttcaatcacatcatcttgctcggagacatcagctgcagctacaattttttgcaaaatctgcgggtcggtcaaaaagttctgccctaaccctttacgcatatgaaagccatgccgcttcaaaatggcattggttacggctggttgtgccactttttcatgcatggttattcgctccttcgttcacctgggcaaccgcggctagaaaatctgcgcgactgatttgaaattcagccagccgccgtaaaagctgtttcccatttgtatagccgatatgcagccgttcgcctagctgttcccgacgctgacgagcaccggttccaccgagcaaatgcgctgccaataaatcctgctgactgatcacttgcggagcatcgggcacttcagtaaacaagtgctggagtgctgcccgcaacgccgctggagaagcatgctcaatcccaagcgaccctttatgatccggcacgccttccgcccgcggtaaaaatgcatgggtaacacctggtacggcacgcgaaatggttttgcgaatcttttcaccgggaaagtcaggatcagttaagacgatcacgccccgttttgcttgggcttgccgaatccgcgccaatgttgcttcatcaatggcactaccgcgagtctcgatggtgtcgatcctgccaaaagtttcttttaatcgcttagtatcatcgcggccttctacaaccacaatttgtttaatcgttgtcatgcgtcttcctttaacttgaaaatttggtgggcattatcccacgtctgcttagcaatcacttccggggtggtttcgcgtagtttagctaaagcttccaccacatagcgcgtatagcccggctgattctgtcggccccggtaaggcgttggcgttaaatatggggcatcggtttcaaccaacaagcggtcactggggattatcttggcactggcatgttcttctggggcatttttgaaactgacgatgccggaataggaaatatacatccctaagtccaaaaaccgccgtgcccagtctgcatcaccggtgaaactgtgcataatcgcgccaaattcttcaacatgcgccgtttttagaagcgcataggtatcttcaaaagcatcgcggctgtggatggacaccggtatgtgcagcgagcgcgccagttccagttggcgccggaacacccgccgttgaatttcacgcggcgaggtattccagtgatagtccaacccgatttcgcctaacgccaccactttaggatcagctaactgttctagcaatacggcttctttagcggcatcatagtccttgcttgattccggatgccaaccgacaattgcatataagttggcatattgatgggctaattgcagcgcgccggcgttcaacgtcgtatccgagccgacaatcgccattttcttcacgcccagctttcgagccgcttcaatgtaactcgcttccttgccatgataaggcgtgtcattcaagtgggtatgcgaatcaaaaatatccatggacgcttactccttttccgctgctgccagtaattgtggcaacaactgctcaacttgggtcggttttctggctgcaaaaagccgttgtagtttggcaaccggcgactgggtcaaagttcgaattaactgcgccattcgtaacggttgttgtttaagctcgggattgaacaacataaaggcccagctaaccggtaaaatccgactcacatcggccaagtctttgaaggcaaccgggatttcaaaatgtaccaccactaagcagcccgtctgcaccaatgagccttctaaatgtggtatcgcaatattaggcaaaccattggcaatctgattcaattgcataccggaaggaaatgtctgctcccgggcaatcagtgccgcttttccctccgtctgcatcacattgcgtgcaaccagtttgcgactaatctcatcaaaaaaaatttcttgggttggcgtctctaaaaagtaaactaatggggtcatactaaactcagccaagcgcttcacctatctttacataaactcaatatggttagagtatagcacgccaagccaagcagctcgcaggtggtttttgggttaaagcttctattattgactgactttctttgagtttcatgaaaatgatcggcgaaaaatgtctattattgtcattttgttctatactaatcgtgtactgaacatttaaggattacctaggaggtatttttacatgtctgttaaacttactgctggtcagttagagcatttgaagcaattgtccaatgacaacaacgtcatctcggctttagccattgaccaacgcggttccctgaagaagatgcttgcagctgcagcgaacaagccagctgacgaaaccacgattgttgatttcaagaaagctgtttctgaagaattaaccaaatacgccagcgcgattctgcttgatccagaatacggcctgccagctgccaaggttcgcgatcctaagtccggcctcttgctttcctatgaaaagaccggctacgatgcgactgaacctggccgtttcccagatttgattgataaccaaagtgctttgcgcatcaagaacgaaggcggcgatgcagtcaagttcttactgtacattgaccctgacgaacctgatagtatcaacgatcgtaaatatgcgtttgttgaacgggttggtgctgaagctaaggctaatgatctgccactgttcttggaattagtttcctacgatggcaagaccaacgaaaccggcaccgctgcatgggcaaaagcaaagcctgaaaaagttatcaagatcactaaggaattcagcaaggcgcaatacaacgtttctgttttgaagcttgaagttccggttgatcaaaagtttgttgaaggttacaccgatgaaggcgtaacgccggtttacagcaaggaagaagctgctaagtactacaaggctcaatccgatgcaaccgatttgccattcatcttcctgtccgctggtgtttccaacgaattgttccttgaagaactcaaatttgctaaggaagccggttcaacctttaacggtgtgctttgcggccgggcaacctggaagccaggcgttaagccatttgctgctgaaggcgaagctgccggcaagaagtggctgcaaacggaaggtaaagctaacatcgatcgtttgaacaaggttttggctgacactgctactccttggacagacaaggttgaaggctaattctttttaactaattaatcgttcaaaaaccagccacagatgcggctggttttttatatggtgagcgtgagccagcccgcttaaaaaccggagtgtaagcgggcttagccgtgatggttgggctttgaccattgcggctaaggtccttacacgcaggtttctgggctggggaacgcgttatgagcgtgaaccagcccgtttagaaaccggagtgtaagtggccttagccgtgatggtcgggctttgaccattgcggctaaggtccttacacgtagatccctgcgccggtgaacgcgttatggcaagtaaggggcaagtaagggccaacgcaaagataaatcatcaacaaccattgcagcacgctggcacagtggtagactgatagatgaatgcgttttcttattttaggaggttgttaagcttgatcacaattgagaatcaacaatttaaagccagcattgccgaacgcggtgctgaactgcagtcactcgtcaacaaaaccgataactatgattatatctggaacggcgacaagactttttggaatcgccacgcaccgattctgttcccggccattggtaaatctaacgaagaccaatatcggctaggtgccaaaacatttccgatgggccaacatggttttgcgcgtgattatgattttgaggtcagcgatcatagcgactcagcggtgacgttcacccagcaccaaaattcagaaaccttgaaaaagttcccgtttaaatatactttagccgttacttatatgctaaccgaagatggtctgagcattcattacaccgtgacaaatgatgacagcaattcgatgccgtttgcgttagggttccaccccgccttcaacgttgcattaaaggcggatggcagctttgacgactacgatttgacggttgaaccgttaaacagcccgttgcagcgctttggtatcgggccagtaccgtttcgcaatggtgacgttgaagatattgcaggcgcagaaggcaataaattgccactcacacatgatctgttagacggtgggttagtgattcttgctaacagtgaaatcagcaaagcaaccttatcctccccgcatcacaagcacagtctcacgcttgatatcaatgacttcccttatctcactatctggagtcctgaacataaaaaggctccgtttattgcggttgaaccgtttgacgggttacctgaccaagccggcgaaccatccgattggtacactaagcttggcaacaccacactttctgcaggtgccaataaacagcttgccttgaaaattgaattgcactaaacaatcttttaatgccgcctgaggtttatgcagacggcttttttgtgcacactttttgtacaaacaccatcactaagcgactgcaaaatagttgcggtacaatagcaccaaagcggtgaaaggaatgaagggttcatgcacattgcagtcattgatgatcaagcagcgactagagaagcaacggtcaagctcattcggcagttagcgcaaccgtcacagccattgcaggtggcggcttattcaaatgccgagcagttcctgtttgcagaaaaatcagccgatctgctgttgcttgatattaagttgggatctggcatggacggcatggcgcttgccaaaaaaattcgccaacatgatcccgaaaccgccatcgcttttgtcagtaactacgacgaattcgtgttcgatggttacgatgtgaacgcgattgactacatcctcaagccgcttacggtggcaaaactcaaacacctaattgaaaaggtagctagccagacgcagccaaaactcttggcattgcaaaccgctgccggtctagtacgcgtgccaatgtatgacatcagcgccatcgaagtcacggatcaccggcttcaagtccatacgcaaaaaaatcactatctggtaaacggacagttaaaagactttttaccgcgcttagatgacaactttattcagatttaccgctccatcgtcattaacctgaatttcctctcgcagctggataaacgaaccgttgtgatggcagatggcaccacttatcccgtttcccgccagcaggcaccgctagttaaacaggcattcttcaagcattttcgggggttgacccatgacagcaattagttggttctggctggtcgcctttgggttgctagtagtaggttgtatgtggcagttatggtggatttttcggcgccagcaaaactggccggtgcgctggttaaacctcatcattgccatcgtatcgttgagcagttggtggttatggccgcttccggttgtccgcggcttgctttttaccatcactgtgttagcaggcagtttggagttcatcttaattcgccaatttctcagtgaccaggatgcggtgtttgcccgcagtcttgataaaatgatggcccaatattcagaagaagtacaagaactttatgcgaatatgcgcggctggcggcatgactaccacgaccaccttcaagctttaaaagcctacttagacaatcaagatactgctgccgcgcgccaatacctaaatgaactggaagacaagcttgatgcggttgatccacttgtgcattccggcaatgccatgcttgacgccatcgtaaatgctaaattgacgttggccgaacgactgcacattccggtaaacgaaaaagtcattgtcggcaacaccccactgatcaaagatgttgacctcgtggtgattttggggaacttactcgataacgccattgaagcaatcagtgaacagccgcccgacgaaaagcggcagttgcggctttacatcggcatcgttaaacagcaattttacatctcggtcaccaacacccggccggccgatcaagtcattgactatcaatacgcctcaaccaaaagcgataaacgaggattgggaattcgccgggtcaataaattagtggcaaaatatgatggcatgatcaatcgtcagtatgaagcttcggtttttgtcaccgaaattgccattcccattcacgcagccaaaccgaccactcacgcataatttgcgtcagcgagtcggttttttggtaggttaaggtcaacgaggtgaatgcgatgaaaaaatatagcctatggaataaccttcgctggtactttgccaatttacgcaaatccaaacctgctttggcatggactgcaagcggcttggctcttgataaggcggccgcggctttgcttggtgtttttacaccggcactgttagtcggcgctattaccacccatgctaccttaggtgaattcgcctggctggcagtgttaaccggactaggattagcgctaactagtgagatagcgtatctgattatgaatcatgatggcgttgcaagctctgcagtacgagtcgatattgaaatggacttccaccaaaaacagtgggagcttgattacgatcagattagcagcggcaaactccaagaattggcccacaccgctttcaataagggcttaagtcgcactttagcaggggccgaagctatctacatttacggtcgtggtactttggtcgatctgacaaccttgattgtcttcttagcgacactgtcatttgcggtgccatgggtttttgcactggttttaatcagcgcggcaattagctacgccggcatgagctggtatcggcagtggtatcaacaaaacaacgtcaagtggaacaagttagggcgccaacaggattatattacccgcaatgcctatgctttggaaaacggaaaagacattcgcatgttcggcatggccgactggtaccatcaccatctcgatcgtctggtgacattgcaagacgcttggcaacgtcgcaactcactccggcgcttcttaggcgaacaagcgggacaactggccggcttggtgcgggacgcaattgtctatggcaccttgattgcagcgattcttcgcgggcgtctttccatcgctcaattcaccttgatgtttggcatgaccaatagtttcatcatcttactggatcaattactcactgattttaacggcttgcaaaatgccagcatcgacttacaagaggtacgcgaatttatggccctgcaaccgcaaacgccagcacggacactgacaaaagcagagcaagcccaattagccaagcgtcctgtcaccatcacgttttcacatgtgacttaccgctatccggaagcgaaaagtgccagtcttaacgatgtcagcttcacactcacagccggtcaaaaattggccattgtcgggatcaacggagccggcaagtcaacgttggcccggctgatgatgggactgctgcatccccctgaaggcaccattaccattaacggtttggatgcgaagctaataccgctagcagctcggtttgctttgttcgcaccggtttttcaggaaaccattgtgctggctcagagtttagccgataacgtagcaatgaccaaccacccagacgcaacccgcgtcatgagcgcattgaaagccgcaaacttagacgcactcgtagcaaccttaccgcaaaaagccgccacccccatgacgcgatacaccagcgatgatggcgttgaattatccggtggtcaggcgcagaagttgatgctggctcgggcattatataaagacgcaccagtgctcattttagatgagccaactgccgccttggatgccattgccgaaaatgaaatctatcaggattacgcccaactagcggctggtaaaacctccctgtttatctctcaccgactggcttcaacccgcttttgcgatcgcattttgttcatggaccacggacaggtacttgagtccggcactcatgaacagttgatggctaaggccggccactatgcccacatgtatcagattcaaagcaagtattaccaaccagctgcaaaggaggtaacggctaatggcaacttctaatcattctgaaccaaaaccttcaaagcaaaccgcaaaccgggcactgcgagtggttcgcatcatccaccagctcgataaattagccatcccggttgaatttctccgcgctttgacaactgtcggtatcccctatttaaacatcgccttcttagggttggtcttgaatcaattgcagcaacatgcaacttttcggccagtcattctcctcattggcggctttttgcttgccagatatctgttgcaacttgctagtaactggtttgccaaactggctgaagaccatgagaccggcgtaaatcgacgacttgatcgcgctaccactgaaaagctgctcaccgtaagctatacaacgcttcaagatccggatatgcgtaatcaatacgccggtgccgtagaaggtaagacttttagtggcgggatcacatcacttatgaaagatggccttcaagacttcttctcgctagtgatcgccatcggttttgcggtcgccactttaatcaacctcacgcaggcaaccaatcatgcagctacttggtttaatgacgcccgctatccgctcttgatcatcgcgttactcctttttccaatcatcgtgggtggttggagtgttcatcataacaatcagatccagcaaaaacttatcagaaagattctgccaaacaaccgccgattcacctatttttcaaacttcacgcaaaatatggacaatcatcaagtcattaggctttatcaggcatccgcgcttgtcatgaagaatgaacgcgacagcatgtatcacttcatggatcagcttcggcttggttactgggaaatcgctaagttcggtcattggcccaatgttgctattgccttatccgtcatcggtttgtacatccttgtcggagccaaagccttaatgggggttctcgccattggcagcgtcatgattgccgttggttattttcagcaactcatgacaactgcttatgagtttctccaagaagttggcgggtatatcaacatgattgattacctccaattttatgctgattttctcaacttgccggaccacgatcagtctggcacactgccggttgaaaaacgcaacgacaatgaattcgctatcgagtttcatgatgtcagcttcaaatatccgggcagcgatcaatgggccttgcgacacgtgaacctgacactgaatatcggcgaacggcttgccttagtcggtcgcaatggcagcgggaaaacaacgctaatcaaactactcgtgcggctatttaaacctactgagggcgtcatcaccttaaacgatatcgacattcaaaaatacgatgaagacgaatatcgcagtcttttgggcgtggttttccaggacttccgcctctttgcctacagcattgccgaaaatgttgccgctactgctcaccccgatcgtgaacgggtctggaaagccttgaaagtagccgatgtagccgaccgggttaagcgtatgcctaaaaccatcgatacaccgattacgacggcgctgagtgatgacggcgtgaccgtttccggcggtgaggcccagaagattgccattgcgcgggcgtggtacaaggacgccccgatcatgattcttgacgagccaaccgcagcactcgatcccatctcggaatatgaaatttatcagcgatttgatgagctcatcgaaggtaaaactgccatctacgtctcccaccgaatgagctcaacccgtttttcgcaacgaattgttgtactcgatcacggcaagattgttcaggacggtactcacaacagcctcatggcagaacccggtatttatcgcgatttattcaatgctcaggcgcaatactacaccgaagatcgcatcaaagcggctcgtaaaaaagtggcaacgacaacaactgcagtggcggattagacaacttattctgacgtcacccagaaggcacactatgaagaatcttggcatggtgtgtcttttattatttttaaaaataccaatgtaaagtttgcttgacattttagccaaaagagactacattcatgatgtaaagtaagctttacaaagcgaggtgtagcttttggaaaatcggatcgaagcattgcgcaatcaacatcacttaacgcaacaagacttagccgatcgcttagaagtgtcgcgccaaaccgttagttctctcgaaaacggcagatataacccctcactcggactcgcatttaagctttcacatgtatttaacctacccatcgaacgcatttttatcgatgaaagtgcggattcgaagttgctataacccatcctgaatgatcaatcactgtttgctttaccaaggaggtaaccgtcatgaaaagaattttgcacgttatgcctttaacgagttggttagcgtggtttggcgctttcgtctttgccatgttataccggtatagcaaggccactgttccagaaagtatcggaaaggttcttttggtaacagttgcggtccttgtcagctatgctatttttgccactcagcagcgaaccgaaactcagcgaatccaaaagctgcaacatggatcgctttctgataagaggcttgctaatgagatgaacgatgagcgcaatcaaatgattatcggcaaagcagcctttctctctattaagtggattgtccttttgaacatcgccgccttgtttgtcatggcagcattggacgtatcaagcgttgccatagttcttcttgcactaagcactattatgatcccaattctcaatatcatccttcaggtacacttgaatcgaacaatgtaaccataaacgcataaaaagggcacttcattttgaagtgcccttttattatagcgttcaattaaccaaccaaactgccattttccaggttttctgagacttccagcaatgtaatcttcttgccgtccaagctttcggctgataacagcatcccctcggacatttcgcctttaagtttgcgtggcttgaggttgaccacagccatgacctttttacccttcaacttttggtaatccggataaaattcacgaataccggacagaatctggcgcgtaccctcatcaccagcgtcaagggtaaacttcaacagcttgtcagcgcccttgaccggttcaacgtttagaatttctgccactcggatttcgctcttatcgaattgcttgaagtcgatttccggcttgcgggtcttttcatcgacagctgctttagccgtgccaggcgtcatcttgctcttgatatacgctacttcttcttcagcatcaagccgcgggaagatcggtgtgccttgttcgacgactttggcaccggcaggcaaggctccccacttcacgactttgtgatcttcgttttcgtgatctaagccaagttgaccgaaaatttgaaccggtgcatgggtcatcactggctgaatgagtaaagcgatcaggcgcaaactttcagccaagtgtgccatgaccgaatcaagctggtctttcttggctgggtctttggcgagtttccatggttcggtttcatcaatatatttattggcgcgggaaacgatcttccagacctgatccaacgcatctgagaaccgtaattcatccataagcttgtgatattgcgccaacgctgcctgcgcaacatcgccaagatcctgatcaaatggggtaacatccggcttgaaggcaggtaagatcccgtcttcatacttgttaatcatagcaattgtccgattcaacaagttgcccagatcgttcgctaaatcataattaatccgatcaatgaaatcttcaggcgtgaaaataccatcgttaccaaatggaatcgcgcgcatcaggtagtaacgcagcgcatccagtccgtaacgttccacaatcatgtccggataaatagcattgccttttgacttgctcattttgccgtctttcatgaccagccagccatgtgcgtaaatctttttcggtaatggcaaatccaaggccatcaaaataatcggccagtaaatgatgtggaagcgaacaatttccttcccgattaactgaacattagccggccagtatttatcaaataaggcgtgatcgttgctgccatagcccagcgcggtaatatagtttaacaacgcatcgacccagacataaaccacgtgtttaggatcagacggaatctgaacgccccaattaaaactggtgcggctcattgccagatcttctagaccaggcttgatgaaattgttaatcatttccgtcttacgcgatgccggctgcacaaaatcaggatgctcatcataatacttcagcaaacgatccgtgtacttgctcatcttaaagaagtagcttggttcatgaaccagctgaacctcgtgaccagatggagccttgccgccaatgactttgccatctttatcacgataaacttcagacagctgcgactcggtaaagtattcttcatcctcgactgaataccagccagtgtattcgcccagataaacatcgccttgcttaattagccgttcaacgatttcctgaactgcctcgacatgttccttatccgttgtccgaataaacttatcattcgtgatctcaagcattttccacagttgcttgatctgtgctgccatcccgtcaacataagcttgcggtgtgacccctagcttgtcggctttttgctcaatcttgaggccatgctcatctgtcccggtcaggaagaaaacatcataacccatcaaccgcttatatcgtgccaatacatctgccgcaatggtcgtatacgcattgccgatatgtagtttgccagatggataataaatcggtgtcgtcacataaaaagttggtttgcttgccatgcaagtgcctcccgtacattaattcagaatgagtctagtataacagagtgtgagcaggaacgcttagaaatcgaagtgagcgtgaaccggcgcgcttagaagtcggagtgtaagtggcctcaaacgtgatggcccggttttggccattgcgtttgaggtccttacacgcagccttctgcgccggtgagcgcgttatgggcataagctggaacataagcggccttaagcgtgatggccgggttttggccattgcgcttaaggtccttacacgcaggtttctgcgccggtgagcgcgttatggtgagcgtgaacagggccgcttagaaaccggagtgtaagtggcctcaggcgtgatggtcgagctttgaccattgcgcctgaggtccttacacgcaggtttctggccctgtgagcgcggttatgggcataagctggagcacaagcgatctcagacacgatggcccgctccacctttatccagctactcttctcaagccaaaatccatacgccccaagcagtcaatcatttgccgccaaccattgatccagaacatgaatgaactcatcatgctgatctagcagcgccaaatgccgactattagcgaacaaatgccactttgcaccgggaatatggtccaccacgcttttggcaatcaaaggcgtgcacagatcatccgttccgctcgtcaccaaaacaggcacatggattttgtgcaactggtcagtcacatcaaaatcactgatggtaccattttccgtaaattcatttggcccttccgcaatgagactagcgcgtttcccattcgtgggtcggcgtaatggttcaggcgaattttcatctggatcatcccagcaatacttttccatgtagcgatcatttgctgccagatacttcacattggtaaaatcaccggtgcgctctgcttcagcaattgccactcggtcttcgtaactaagatacttgattagccgatgttgctcttgaacccacaacttaattgatgccggtgagccatcaatcatgacacttttaatgccttgcgggtcaaagctagtcagataatacatctccaacatcccgccccatgactgaccgagcatatgtaactcatccaagtgcaggaacttacgcaaagcaacaagctcttcggcccaagtttccttcacataaacccccggatcttccggaagcgatgacttaccacagccaacctgatcatacataatcaactgccgaccggtttcggcatagtcatccatgagctcaaaataattatgcgacgaacccgggccaccatgaatcaacaacaacggcgctttatcggcactaggttcaccgacaatgcgatagtaggttttatattcatgaaacggcatgtatccttctttaatcttcacaaccatccaaacattcgacctttcaagaaagtgagcgcgagccggcgcggttagaaaccggagtgtaagcggccttaagcatgatggccgggctttggccattgcgcttaaggtccttacacgcaggtttctgcgccggggagcgcgttatggtgagcgcgaacagggccggttagaaaccggagtgtaagcgtccttagacgtgatggcccgggtttggccattgcgtctaaggtccttacatgcaggtttctggccctgtgagcgcgttatgggcataagccagaactttagcggccttaagcgtgatggccgggctttggccattgcgcttaaggtccttacacgcaggtttctgcgccggggagcgcgttatggtgagcgcgaacaaacggtcttctacgctagcaaacacgttacgttatcgttgccaaaaatcgcacgcacgcaacctagcgtacttactgcgattttactacgcatcggcaatactgtcagacaaaatatggaaattgtctaaaaaaaccattaaaacgctaaaacaaatccaactgccgcggcgccaacccgggaaaatccagccctaacatttcgatgaaactttgagcgtttgctgctgcgtcatgtccgccattgttattgaagataaccgtcacatttttgctcttcaaatgcttcacgattaaggcaaacgcctctaactcggcttgactataccgataattagttcgttccgttgtcttagcaccgctttgcccccaagcctgattgcgtccgtgcaaccgtaaaattgtcagttcagggttcgttgcaattggcaccaatgggactgaaccgctcacggtctgcgcctcatcgaccaccacatgaatgtcaccagctgctttgagcaagtcaatcgttgcggcacgatacgccggtaagtaccagctaggatgacgaaactcaatagccactggtagatcaggcagccactgattcatattttgtaaatatcggacattttccgccgttacgccaaagtatggtgggaactggcacaaaaccgcgtgtaattgatgcgtggcagtcaacggcgccaccatgtcgttgaagcgcgaaaattcggccaccaggtcttgcgttgcggcgtgtttcgtcatcaatttgcttgctttgattataaactgaaagccggccggcacctgcgcctgccaccgtcgcactagatcagcggttttcaacccataaaacgtggtatccagttcaatgaccggaaaatactgggcgtaatcagcaaacgtactgcgcttaccattggccgccaagctagggtgatcggccacgctggttaatccgaccctaatcatggaactcaccatccgcaattcgaaatgcctgaagcgtgtcgccgttaaagtaggaagcataatcatgtttttcgccattcaacgcatatttcaacaacggctgcagatccggcaccaacccgggattatccgccagcagccacgttttggaaaaggtcgctaaaataccttcccgcgtcgctcgcggtcctaaaaacggctcatcggttttcccgaaaaaggcgtaaagctcaccccgtaattggccatcaacatgccaaaaaacgcgcccaacgcccgttaactcatgagcagggatgataatgtggctttcctcctgtaactcccgtgctgcacaaacagcaggtgtttcatcaggcaggaacttaccacccaacgtattccacatcccgcgatacggtggattcgtccggttaattaacaaccaaccacttggcgtttcaacagtcaccaacgtatattttttaaccatacccgaaaaactccttattaaggcgtaacattcaaattaactctagtaaaaaggcgccgatttgatcagcaccctcaacgttggagtaaaacgttagagaataccggtcacaatttggcgtctttttatgcatgacatcaatgctactggattaatcttacttcatcttttccactgtagctttaatgatgcccgcggaatgaacatacttagcacgctcttcatcggtaagcttcaacttaggcgtgttaacaacaccgagcttgccaatcgtcgccggatgaccgatggcgataccgaattcaggatcatagttagcgcacggaaaaatccgcttggcatcactgataatcgcctgtgtcatttcagtagcaatggtggcaataccgtagctggtataatgtttggcctgataaatcttccagccgccagcccgcgccgcatcagctaattgatcataatctacttgcgcataatccgtgattggctcgttgttaacccgcaccgttgaccacgccgtaaattgtgactcgccatgctcacccatgttataaccgcgaacatcggcgacattcacatttagcgattcagcaaccgcgcgccgcatccgataagtatccagcgaggtgccggtgccaataatctgggactttggtaggtcaagtaaatattgccaatagctggtgacagcatcacaaggattggtgatatccagcaaaacgccatggaatccggacgctttcaactttggtgccacatcgtctaatgcttgttttgacgtttgggtttcaccaattcgatcgccgtttgaaatcgcaccgatattgccaaccgcggaaatgacaacatctgcatctttcaaagcatcgtaatcattgacgataatctcggtataagtcggcaatccaccaagtgcatccttcaaatcataactttcgccttcagctaaatcagccttttggtcaattagcaccagacgatccgcaatccccttgctaacgagattaaatgctgttgtcaccccaacatgtccaataccgataataccaatggttcttgccaagataaaaaccccttttcacaaagtttagtttttcgggccatgtagcaaatgccgttcaacccgctgatccgggatggcccacaagagtaacattaccaagtccagtatgatcgttaacggtggccaaagcaaagccaaaatcatggcaacaaatgcgatgatgatcgaaccgattgctttccagttatgctggcgattgtataaagcagccagttcagagtgtggtccattaactcgccgcaatgtttctaccaacaatagataactaatattggccattaaaaccacaaagccatagatcaattccggtccaaacgcatcaacatgcccttcgccaacccagctggtagcaaaaggaaacattgaaatagctaacataaatagcgagttggcccacatcacccgccaatcaatgcgcttaaccagctgaaaaaggtgatgatgattattccagtacaccatcaacgttaaaaacgagaccaggtaaataccaaacacgccgcgaagttcccaaagcgaagccaatgaaccgctgtggggcggatttaattccaacaccaaaatcgtcaaaataatggcaatcacagcatcggtaaatgcttctagccgtcctttgttcacaagccattccccttttcgtgcaccttgtaaatgatcagacgtgcaaatcggcaaaaatatcggtggcatctcccagtaccatgtggccaccttgaggcaaggcaatctgctcccgattaacggccacaatcgtcgcatccggttgcgcataaccgataagtccggcaaatggataaaccacaaaactggtgccaacgacaatcaataagtcagccgaagcaatcgcattaatggcggcactgaccgtatccgggttgattggttcgccatataacacaatatccggccgtaaaataccgccatctgctgcgtgcacatcgcttttcaaataagtctgataatcaaaatgttggtgacacttctgacaataaatgcggtacagattaccgtgaaactcgaccacatgcttggctcctgcttggcggtcaagtccatcaacgttttgcgtaacaatggcgcccttttgattactaatcgccgccattttttcatgaatcacattgggtttggcatcagggtaatacatgttgttcacgacgaattcatgaaaatcttcatgatgtgcctgcagattatcaatggaaagcgcgtactcgggatcaaccttatcagcatacaggccaccctttgagcgataatccggaatccccgaagccgttgacacccctgctccggtcataaacgtcacatacttagcctgagtcactgccgtctgtaaatcaaacattagccatccctccgtcgttatctcttcctatcaccaatatagcaagcatcccaaccagtattatttaattgccgtcaacgtttccccttgacaagtcgtttcaagtccatgacagcgcattcagccgtcaaaaataattttgtatttcttaacattctacggtcgaaaggtgtaatattattctatataaagattgatagaaaggagtcttgattgtcatgaaatcctttcggtggtcgcacttctttagttatttgattatggccattgttttagttttctttgccattgttctttaccaggtagtcatgcttggtattcaatccgtcactaacggcttctttattaatttcggtcatcattaacggattgtataatccagttggtactgcgccagaacgtcattcagcggttgttgatacagctgctggaaggcttctggcgttgttgcgttttcgggcagcggcaagacgaatgcattttggtcatcacttcgacccatggcaacataagcaggctgcttagtctcccgatcgcggtagccgctgtgcttgattaggtaaacctgatccaaggtgagtcgcaattgccgtttggataaaaccggtgacaacgtagcgaattcctgatcgtttgtgggttgatagcctagttgctcaattaaggcatcaaagcggctaaacaaatgcacgatggcacggcgcaacccaaacggtgaatcgagtttctgctcgttaatcaactgaaaaagttcttgagcgtaaggcaatgcttgcgggtaggcagctgccaaatcagcgggcagcttgccatctaaaaagcctaacagatcaagtaacgataaaattcggtagatgaccaattgattgtcagcttcagcaggtacattttgcttgaatccggctaacacttgcgccacgaccgcatccgtgattaacccgtgttcgcgttgccatgccaccaccaacatatgcaccgcagcgttatacaaagcggtactggtggcgtaaagctgatcatcgacttgaggatcaccgcttagcaaatgaaattgcaactgcggatagcctttcatctgatacaacaagtgaagtaattcgtgactcagtgtgtaatccgcattcgttgtatccgtcaccactacctctagcgtaccatcttttttcaatcgctgatggctctggtcgtgagtcaagaccccacttgcctcgccttgaatgaccacttctaacggatgatcatagtgttgtttaacctcgtcaagtaatacctgaacattttcttgcatgccaataattctccttttgcctgcgtgatcggaatattgagccaattaagcagtcatttttccggtaacgattggctttcatgtttttgatccactatcattaaggtagcgataaaaaggaggaaattcaaatgaaactatccgtaccacttgttaacggccagcttgatgatcgttatggcaaacatgctaccggtgctgatgttaaaaacggttacccgattacgagttttccgtttacgattgaagatgcccctgcaggcaccgtcagttttgccctttggttcctcgactatgatgccgttccggttggcggcctgccgtggattcactggaacgcagccaatattccggcatcggtcactaagattcctgctggtgccagtcatcacgacctcgtgccgatgattgaaggtaaaaatgcgacggccggtcacttggtgggtaacacggatccatttacacgggaaggctatgttggcccgcaaccacctgacaaggatcacgattacacgttgatcgttttcgcgttagatactaagttaccactgcaaccgggtttctggttaaatgaagcccgccatgccatgaaaggtcatattttagcccaggcagaagttgacctcccatcacgggtttaagtgcggggttgctaaaaagtaagttactcaaaaagcctgctgatcagtttcagcaggctttttgaatttagctcaacttcgcaactttacagtccagtccttcaactgccatcgccggtgttcatccataacgctccggcaccgaccgcggctaccaggccaatgccgataataccgaccaaggcaaatttgaaaattgcaaaaccgccgagtgcaaacagcgccagactaataaacgggtgccgcaaaattgcaccgaggagtttaacaaccaagaacaggataataatgatggcaacaatagcgccaatcgtgatggcacctgttagcgtatgtccgttttcgctctgtgtacttgccagcatacttggtaacatcatgaaacttcacctctcttaatggccaatcccacgcagctgcccgatttgactaaaacatgctgcgaacccactggacaatgccactaaaaaagctaacgatgccgtcccagattttctgtaggaaattacgattttcctgcgtattcaaactactattaagcttgtcgaataagcctttagctgaattttgaattgaatctgccagtttgccagcctgcgctttaaaatcggtattcttcaaggaaccggccttttggacattcactagcaagttaatgattaattgccgctgattgttattaataatcgtggtcagattattctgtttcagctgactgtcaacgatattgccaatttggttctgcgacagggtttgctgcccattgttactttgcgaagccatttgctgtttggctccggcaactgcattgttcagctgtttgtcggtatagccatctttgcctttattagcctgcgtgatcgaactcagcgtattgacttcctgctgggcggcattaatctgttggttattcaggttctcgccattttgggcaaacgctgcataaacccccgctaacgcaccggaaccatcgattttgaccgcactggtgatgtataaattagcattgctgaccccggccgttaatgcggcgtttcggtattgatctgccgtaatcgtggtaatgttattcgttccgttatacggcacaatggtgacattaataccgccattatttgtcttttgtactaaggcactggaccacacgccggagctttccgtaaacgagctgccagaaggattgagatacttcaccaaggtggcaccattaaccgtcaactgtgtggcattggagacgcccgctgcgttttgtaatgtgctcagcgttccgtttttctggtcggttgtcagcgaagaccctagcgttgcaaccggctgggtccaggcatcatcagcccgcacgacttgtggtaccgctgtaatcaatgccagcccagccgcagccagtcccagccatttaatcagttttttcataactcaaaaccgtcctttaagttgttacgactattatcgctgatttgctgcggctcgtcagaaatcagcattcggtttaagcaatgattaattaatgttcccgctgattcacggctcgggtgttcaggtgatcgtaaagcgcgccttcacgtaacccaaactgtgaaaaggttaagcgatcagaatcaaggtaccgaatcatcgaaataaccggcatgagtccgccgacaataatgtcagcccgatatttggacaatcccggaatggcttcgcgggctgccaggtcggagctgagaatttctttaaaaatattgttggcctgctgtgtcggcatgcggtaaccgtgaatggcttcaaaatcggctaatttttccttacgccgttcgatcttcgccaaggtccgattactcccgcccaacgcaataattggcaggttttgcgcgcgtcgtaaccaccagacactattaaaagtctgttgaataaaggtgcttagcgcaaaatattcggcggctgaaattacatcaggattcaaaaaccgctcagataagttaaccgacccgaatggaatcgataccaggtgttgcaacttacgattttgaaccagaatcaattccgtcgaagcaccgccagtatccataatcaaggcgttttgaatcggcaacgtattgataacacccagaaaatcgtattctgcctcacgcgtacccggaatgacgctaatcgttaaaccggcttcgtttttgacccgtttaagaaagtccttttgattcttggcctcacgaacggcagcagttgccacggcttttagatcaatgtcatcgtacttatccagttcggctttaaacccttgcagcgccttgagcgtccgcgccatggcggcaggttgcagaatacgggaggatcccatatcttctgacaagcgcaccatttcttttagccgtttgacgggcttaacgacttcctgctcaattgaccagattgtcattcgtgcagagttgctacctagatcgatgactgcgaagtggtgcgtcatgcatcatcatcctcctttggtgctgtcattgggataaacgtgtgggttgcgtgtaaatcctcaggtgcctgatcaatttcttcacgtcgtaacgcctcacccatggccacagcgtgttcaatgaagtaagcctgagcgttgagttttgtcacaccgcgcaattgtgcccggatccaggtactgtctggctgtaaaatacgcgttttgacgttatcatgccacataatatcgaaaatcttgatgatccgttcccgaatatcatcttgcaaaatcggaaacagcaattcaacgcgccggcttaaattccgattcatcagatctgccgaggacagatacacattttcctgcccgtctgcataaaagtaatagatgcggctgtgttccagtaactggccgacaatggaatgaacggtaatattatccgaaacaccggggattccgactttcaaattgcaaatgccgcgaatcagtaaatgaatttcgacgccggcatgcgaggcttcgtaaagcttctcgatcatggcggtatcagacagtgagttcattttcatttggatcaaagctttgcgtccggccttagctgccgcgatttcttcgtcaacccgatccattagataatcacgaatgccaagcggcgcaatgactaacttgtggaaataaggcggctcggaaaatcccgatagcatattgaaaatgtttgacgcatcttcgccaatttcgttattgcaggtgaacaagcccatatccgtataaaggcgggcggtgacatcgttgtaattaccggttgccatgtgcatatagcgtttaatgccatcttcttcacgccgaaccactaacgcgagcttgcaatgggttttcagtccgactaacccgtaaataacgtgacagccggcatgttcaagttcttgcgcccagtggacattattctcttcatcaaatcgtgcttttaattccaccaatacagtcacttgtttgccattttccgccgcttttttaaggtaacgaataatgggtgatttgctcgatacccgataaagcgtcatttttacagctaaaacttgcggatcctgagcagcttcccgaataaagtcaacaactggctcaaagctgtcatacggatgctgcatgaaaacatcacgttctttaatcacatcaaaaatcgaagtgtctttaaatgccggatcgatatacggggtaaatggcttaaagagtagttccttatgtccatgcacctgcttaaccaacttactgagaaagttcaaatcaatcgggccgtgaatttcgtaaatatcttcttccttgacgttcatggccttggtcaggcgtttgcgcaggtgtttacccatccctgcttcaatctccagccgcatcactttaccacgttggcgcttcttaagttgtgactgaatctccttcatcaagtcagaggcatcttcttcggccacgtccatatccatatcacgcgtcacccggaaagttgccgtttctttgatgtcagcgcctacaaagagttcgcccacaaacatgcgaatgacctcttccagcaaaataaatacgttatcaccgcctggaagccgcaagacccgcgggaagacatcgggaacctgcaccatcgcaaacgatcgtgacttatcgtcatcatcgtctggtcgcacaagtcggattgccaaattcaggctgttgttactgagaaacggaaatggccgggttggatccactcccattggcgtcaataccggataaagctcatagtgaaaataatccgacacaaaatcctgttgcttttgggttaagtctttggcatgcagcaactgaatatcgacagcattcaattttggtatcaacgagcgtaccagtgtgttgtattgtttttcgaccatttcgtgggcagtttttgaaatggcatcaagctgttcctgaggcttcatccctgcagcatcaggcttatcgtaattaaccgtcaccatttttttcaatgatgcaacgcgaatattgaagaactcatccagattactttgggtgatgcctaaaaaccgaacccgttcgagtaagggattatttttatcccgggcttcttccaacacccgatcgttaaacgccaaccagcttagttcgcggttattaaaataccgcggcttcgaaaaatcaagctttttcataacgtgtttcgtcctttcagctcaagtcctacgccaaaaacctcggagaaaaattcacctttacgcgccaaggtccagcgttcaagttcaatatcatcattggccttcgccgacaacaccactttgtctggcttcagcgaaacgcgcattcgttgaatcttttgctgccgcgatgcatctaaactgtctgctacccgtaaaatggctgatagtttggcgacaactaagcgattctcggtcgacatgatcgggaagttcttcaaatccgactggggggttaccgaactgtgaaagcgcgtgatggtagcgaccatggtgacgtccagtgcatttagacccataatttcagaagccttaatgatgtaattcgaatgcgcatagtgtttgtgcgtttcaatataactaccaatatcactaaccgttgccgcaacctctagcagcagccgttcatgcttgcccattccatgtaatttcttgagtcgatcaaacaattgcaaggcaaatgtacgggttgtctgcatatggtcgcaatcaacccgataacgtttagccagattattagcgctgatgacaatttcttcatctggatcaaaacccagctttttgaagccaccagcatgggccgcgtgcacttccaaaccatcaatcgcctttaaatccgaaatccaaattgattgactgtttaacgtttcaatcaaccgataaaccaacaggactgtcggtaaaaccaatgacgtttgatttgaagttaaatcataagtatcggccagatattggtcggaagcttttgtcacttcatcataaagcaaatcaaagccgggacgatcagtctcaacttgccgcttaccttctggaatcaggttttgaaaaatcgacaagctgctgcccattaaaatcacattggtatattcaaccccttgtggcaataagcgcataaaatccagtaagcggctgtcaatataatcacgcataacctcaacgtaattggttaccgagcgctggacatcactcataatttcatatacccgcaacggtcccagtgacaggttacgtgaaaacccaaacgttccttgactaaaagtcgtcaactcgactgaaccggaactgatatcaataagcacggttcctttttgggtaatcgtttcaaactggggaaacttgaccataatcgcctgggtacggaaaaatgcctcttctgacaaagaagtggttttaatgagccagccggtacgcgtgtatagctgatcccgaacaaactcggcattatccgcctctgcccagcttgtactggcataaacattaacggttgcaacgccatagtctttaaagatctgatcaatagcgtcaaaggcctgcacaatggtgtcaacggtttccggtaaaatttcatgttcagcataaaaatcatcaccaatagcaactgggtatttaccgcgctcgattgccttaagcgtccgtagattcgtgatactaaaaagaatcgactgtgcgctaatcatcacgaacccctgtatattgtttgccatgtccgctccatccgtttcttctgaattttccaaagatcattaatgttctaatgccatgatagcacggctattatccgctgtgagaatttttagacaagccttattcaaagccgttttctcaagcagtttcagtttaccaaagatcccatcatttcttttataaataaagagtgctatttattttttctcagatagccatcaatcggcaatccggtttttgcgcgcttccactggggtcatcacctcaactattggtatttgcgtaaaaagattgtaacgacccaatcttttgcgcaagcgccatcatttttgtgatagtcttaaatcatcatgaaacctttctgaaaggaagtctcacaattgaaaatgatcaatctcgggcgctccggcttaaacgcttctgccatcgctcttggcgtcatgcgcctaccgaatcttgatcgtccgcgcgcaacggaattgctcgatgctgcttacgatgtcggaattaacttctttgataacgccgatatttacagtaatggtaaggccgaacagttattcagtgacgcactgaaaaaagcgagcttcacccgtgatcaagtcttgattcaaaccaaagtcgggattatcaatgatcgcaaaagcatgcaccgctatgacttttccaaaacgcatctggtgacggctgtcgaccaaagtctaaagcgtctgggaacggattatgttgatagtttactgctacaccgtcccgatccgctcatggaacctgaagaagtcgctgaggcgtttcttcagttgcagaatgaaggcaaagtgcgtcagttcggcgtttccaactttaatcctgctcaagtcgatttgctgcagcaagctgtcccgcaacgccttatcatcaatcagttgcaattttcgctcatgcatactggcatgattgatgccggcatgcataccaacatggccgatgcacgttccatcgatcatgatggtggccttttgccgtatagtcaacaacatcatatgaccattcaggcttggagtccgttccaatacggtttctttgaaggggtcttcatcaataatgatcaattccctaagttaaatgcgctgcttcaaaaactagccgaccaatacaccaccaatcctaatgccatcgcggctgcttggcttttgcgcgttccagcgaatgtgcaggtcatcgccggcaccaccaaaccggcgcgtctgcgggcgattgctgaggcagcagacatcaccttaagccgtcaagaatggtatgatctttattttgcggccggtaacgacctgccttaagcctaaatgccattttgattggtagctatcagacaccaactcgtaaatgacctaaaaattgacacatttaatctttctataaagggagtttcgcatgaagaatcgactcgatgatattacagatttaatggcacttggtccgaccccggacgcccgtgacattcagcgacgtcaaaccgcccaccgaatcgcaattgcagacgcttggcaaattcaaccaggcgaaaacatcttggaaatcggctgcggtcaaggtgacttaagtgctgttttggcagatcaagtgggtcccaacgggcatgtcaccgggatcgacattgcttcgcgcgattacggtgcgccgctcacactcggacaagcgtgggatcatctgttaaacgggccgttagcaagtcggctgacagtacactttgataccaatctcaccgccagcctcggaccggttgccaatcaacattttgaccgcattgtgatggcgcatagtttatggtacttcgcatcagccaatgcgtttgccttgcttttgaaaaacttgcgcaccattggcgattatgtcgatcttgccgaatggtcacttcaccccaccgcactcaatcaaattggtcatttacaagccgcgatgattcaagggttactttatgcgattgcgccaagtgatgttgccaacattcgcactttaatcacgcctgataccttagcgcagattgcccatgatcacacatggtcctacactgctggcaagctaatagaatgtccggatctagatgatgccaagtgggaaatcgccaccactaaggctttattgaccgagctaaaacttagtaccgatttgcgtgatcgcgtaaagccgcagctagaggccatgcagcataatggtaccgctagtttgcccacatttaccggtcgaatcacgttctaatgcataggaggcgtcagcatgatcgaatttgttcccgccaccaccgcagatctacccaagattgttgccatttataatgagaccatccccacgcatcaggcaacagcagatttgcaacctcaaactgttgaccaaaaagctgcttggtttgcagcgcacaatgatcattttccggcatggatgattcaggttgatcatcacaatgtcggctggctaacgctttccgcctacagtgaccgggcagcgtatgatcaaaccgcggaaatcagcttgtatctggacatcactgcccgcggtcaccatatcggcagttcggccttggcatttgtggatcaagaagcaccggctcgcggattgacaacgatcatcgcaagaattttcggccacaaccaggccagtcggcgtttatttaagaaatttaactacgaccactggggccatctaccagctattgccgatctaccagaaggaaaagccgatctggaaatttacggcaaacattttaaaagctgattggggcgcccactaacaaaaaatttcctactaaggttaatcgccaaaaaaatcagttcttcctgcagcccactaacttaggaagaactgatttttatattccgtcatgttgcttttcccataacggctacttctacgctttttcccctgctttcgtatcttcttgctgtctaatccgccgcatggtgcggatgtaggagctgaccaatacgagcacgctaccaagccatgccaagggattggccgccgatgccccggcaaagccaaacggtactacaaggaaaatcgccgcaaatgcccgcatacctaattcaaaaaatccggccacagtcggcaccagcgtctgtcccaatccttgaagcaggttccggacggtaaataggatggctagcagccaatacatgctggcattgtagtggaaatacgtttgggccaaagcggtaacggcgggctgattcggtccgagaaacaaattgactaacggtttactaaagacaatgatcaaggcacccaacaccagcgataagccaacattgaccagtaaggtttgatacacgccgcggcgaattcgaccgtacgccttggcaccgagattctgcgcggcaaacgttgccatcgctaccccaaacgaagctgaaggtagtgtcgcgagctgatcaatccggccagctgcagtataggcagcaaccgcattcgtaccaagcgtgtttagcatcacttgcaagataacagcaccgattgcaatgatcgacatttggaacccaattggcaagccgacttttaagtgtttaacaatatcctgccaatcaaagcgcaagtcgctgcggttaatgaccaacaacggaatccgcatgcgaatatagatccaacacagtaacgccgcaatcacctgcgcactgacagttgcatacccggcacccgccacgccggaatgaaaacccagaataaaccagaaatccagcacgatgttaataatcgtcgcaatgatcaggaaaaacagcggtgttcgtgagtcccccaatgcccgcaacatattactcagcaagttaaaactcatcgaagcaataatgccaaaataaatcacccgcacaaaggcaatcgagtcatccataatatccggcggcgtctgcataacggttaataacggccgcgtcatggtcacggcaccgattgtcaaaataacggaaattcctagcgtgatccagacactcgtcccgaaactacgccgcacccgccgataatcacgtgctccatatgcttgggctgtcaagattgacagtccagctgtcgtgccttgcgcaaagccgataatcaaaaagacgatactcgaagtcgcaccaaccgcagccaaagccgctttgccaatcgtacgaccgacaatcagcgcgtccataaaactataaagctgttgaaaaagattccctattaacaacgggatcgtaaataagatgatcagtttcaagggtttgccaattgttaaattgcgcatcaatctatcctccaagattctttcatacctggttacgtgatgatgtcagcgcgtgtgttggttgggcatcatcgaaacttatggggttgtgacgtacgggagcggtttgtagttttgggctttctgcgcttttttcgctcaaatgtgcttccccggcgcagaagtctgcgtgtaaggacctaaaacgcaatggctaaagaccgggccatcacgctttaggccacgacgaaccactttacgcccataacacgctccccggagcagggatctgcgtgtaaggaccttaggcgcaatggccaagaccgggcccatcacgcctgaggccacgggattctcctttacgcccataacgcgctccccggcgcagaagtctgcgtgtaaggacctaaaacgcaatggccaaagaccggccatcacgttttaggccgcttacactccgacttctaaacgcgccggctcgcgctcactaaactgcaatccccccacgatatcacaaaaagccagacagctgaataactgtctggcaattgaaatatatttgcaatcaaacgtcggcaccgccgcctccggagctgccgccgccccagcttgagccaccgccggagccgccgccaaaaccgccgaatccgcctccgccgcctcttcggcctgcagagaacaaagcatctaggatgagccatagccagaagccgccatcgccatcgcggcgccgtccgccacggccaccgccgccgcgaccgccgaagatgactgctacgaccacaacgacaagaaagatcacaacaatctttcctaacaaactgccaccgcgatttcggtctgcattttggtagcgattcatcgtttcatccgagaccgtgttttgatccttagggaatttatactttttatcaataacggtcgcaacggcattgaagaccttacgcaaagcctgattcagttcggctttattacccgatttaatcccttttaggttcgtattgaggatttgtcccgccaaagcgtctggcaagtcaccttcaaggccgtaccctacttcgatccgcagattttgcttacctttattatcagcgtataaaatcaacacgccgttgtcggtgccttttttcccgatcccccatttttggaaaagatcaggcgcataatccgacaatggatcgccgtgggtagactttagtgcggctaccgcaatttgcggctgttgtttggtgctttgataataacgattcttttgatcaaccagttgttcggtttcctgatcaaggtaacgatcctggtccaggtagtaatggtcagttggtcgtgccggcagatcctcggccgctgctaccggacgagctgcaccggtaaacaacaacaagcccgtcagcgcggctagtaaccacgctaaatgcctgcgcatggcgccacctacttcccagaactggagctattgcttgaaaaatcaacactcgggacggtctgtgctgatggggtagctttgaaggtgtccttcttgcccagccccatcatgcttgcaaagatattcttcgggaaggtaacaacgctttggttataatcccgaacctgatcaatgtaacgcttgcgttcaaccgagatccggttttcactaccttcaagctgcgtcatcagcgtgttgacctgattactgctttggaggttaggatagttctccttgatcacattaatcaacgtcccaacactcttattcagttgatcatcggctttagccttgctggttgttgagtcggcgttagcataagacttccgggcctcagcaatatcgccgaagactttttgctcctgacccatctggcctttaactgcattcaccagattcggcaccaaatctgcgcgccgctgcatcacattttccacctggctccattgggcttcaacagcttgattctgcttggccaacgagttataagtgccaataccaaaaatcaggcagatcgcaacaatgacaccaagcacaatgctcgtgactgcaactggacttaatcgtttcgttttcatcatggattctcctctagtacatgcgccgttaataagactgttaatcgtcgtcttcagttataaacttattaactcgcatcgtaatcaattaccacttcctttatattttaccatgttggttgcattcgacatccggcttaagacgtaattacctacttaaaatagttaaagccgatcgcatcccggacttcttgcagcgtttgattcgcgacaacattagctttcgccgacccttgctgaagcatttcggccactgcacccatatcttcggcatagtgggcccgcctcgtccgaattggctcaagaaccgcctccatcacgtcaattaagtagcgcttgatcttcacatcacctaagccgccatgttgatattgctccttcaacttagccacctggtccttgtccggatcaaaaatatccaaataagtgaagacaacattgccttccaccttgcccggatcgctgacatgaatgtgatttggatcggtgtacattgacataatcttcttttgaacagtatccgcatcatcggctaggtaaatgccattgttcaggctcttgctcattttggcgttaccatcgatccccggcagtcgtcccagaccttttggcgggaagtagccttctggttcgactaagacgtctttgtgataggtccgattgaacgtgcgcacgatttcgcgcgtttgttcaagcatcggttcctgatcatcgccaaccgggaccgtggtagctttaaaagcggtaatatctgctgcctgactcaccggataaataaagaatcccgcgggaacgctgtcgccaaacgctttttgcttaatctctgccttcactgtcggattgcgttccaagcgattgactgtcactaaatcaagataataagcggtcaactcaaaaagcgccggaatttggctttgtaccaaaatggtcgtcttatccggatcaatcccgacggccagataatccaatgccacttccaacaacgagtgacgaatcttctctggatcattggcattatcggttaatgcctgggtatcggcaatcatcacaaacggctcatattcgcctgagttctggagctcaacccgattcttcaaagaaccaatataatgcccaatatgcaaccgtcccgttggccgatcacccgtcaaaatcactttttttgccatgcgtgtttcctccttaatttaaaaaagcgtcctatgtcatgacaacataggacgcaagcgcgcggtaccacctaacttgtccgaatttcggaccgctcttggcttaaggcgcacccaccgaacgtaacgcaaacgacccaatttcacctaccctggccatcgacttctcagcgctgccgactctctggcgaccatttggatagggtactcatcgtttgtatgaatatgggtttaggttagctaagattttggtagaagtcaatggctttaaaaaggaacatcttgaccaaaaaccttaaattttaaagatagactgtgcttcgaaccaccataggatacatttacagtcaatttactatttgtttacatcatcttaattgatttcaagcgtgagaagtctaaattgaaaatatggagatcatcgaaatgatattttcagtgagatagttttttctggaggtgactcagtgtttaatcaacgctactggaagtcaaaggcaacactcatcgcctttttattaggatttctgctgcttatttcgcacctgatgaccttactttcacttgataagtttggcgggaaacaaacagtaggctttttcttcttttcgccctatatgaattggttaccggtcgacatttcgtctaacttatttgtggtttggagcatggccgcgccgcttttgtctgtgctggcaggcgggatgtttgctgcttttgagggacgaaagggcttttcgaaaatgctgcgaacccggcttagttttacagcatatcggcgtaagactttactggctggtggcttttggggcgcacttttgccgatttttctcttaacggtggactttttaatgcaatttttgattcagcccaatgttgctcctaatgcgtggttgaataacaatgttgccattagttacttgggcttttttggcgcttttttctatgcgcattcaggctggtacgttgtggggtggatactactggctggtgtgtatggtgctagttatgccatcttttctaactatttatattttgagaccaaaaagatgacgatctcgttgctcggcgtcatggtcttgcaactaatgctattaggactgtcgatgatcttgggtcagagtcttgcgccaattggttacatgcaagtcgtaccaactatcggccagccatcactggcttacgtctttctttggccgcttgtctttattgcgttgagtctgcttgcttttcatcggccagccgtggaggtttgatgcgatggtgaattcgaaaccgcttattggcgtctttggtttattaccaaaatggcagagttttttgtttggtttgatgagtcttgcgtgctcgctcagtttgactttcattggccgcactgccagtaagttttcggtcagtcttctatgggctaatctcgtcattcagcggacattcggacaactgatatgttttctgccgattattggcatcatggcattgatgatcattagtaaattacgaaaagccaatctgttaattcgcttaggttcaagagctgcccttgcaaattaccttttaattagtttactcaaattaactgctattgtgaccggtttgattgtgggtatctggttagcgacgtttgccgttgttggttcttttacgctgacgatggcaagcgtggccgctatcatcaacttggtcatgaacacgctgacggcctgttttacatatacacttgcggccatcgttatcatgctcctggtgcgttcagctgccattggtgtcctgattagcctcggtggggttatttcgatttatgttttgcagcttgatccttttttatcgttgatcacgccaagcttaaccctaagcgatgcactgtggccaattgatgtcgttaaacagctgttgcttttaatcgcggtggcagaagcgttacggatggtgctgaacgtgatccggttaccggcggaggtgtgatctttgtggttacggcgaacacgcctggtttcaaaatcgggatataaacgcttagttacctgttgtggactatttctggttttattgggcggctccatcgggttagatgcgcaatatgtacataatcatttcttagtggcaactcaagacaccgtacaggcgatttttttaggtgcgccaccggaagactttgcgagtggccaggtgctgtggttatttttgtggtttggttacttgtttttgccgatcgttttgagtgctggcgtcacgtcagcttatcagcagaatatgtttatccattacgctgtgcgcttccatcagcgattttgggcttatttatggccgctgagagaattgctcttattgcaaatgatttttctcatcttcatgggtggcacgatcttactggcaaatcaggcgggctttttcgggtcacgcgggtttacgcatccggctttttggctcgcacttgtcttggctcaaatcctgcaattagtcatcatgttggtcattgaaggccggttcaatcttgtcattggcattaccgtttcgctaagcatcttgtttcttagtatgttgcaggtgccattcatgccatttgccaccttgattggcagcacgttcccgactgatgcacaactacttggcactagcagttatctgctcatactcatttgtttattgctactcattcaagtcatctacatgccaggaaggtggttaaataatggcgcaacccactaacaacaatcaaatcgaaatcaagcagctttcggtcgtcctcaagcgtaggaaaattctcagcgacatcaccatttcatttgccggaccgggtatttacggcatcgttgggccaaatggtaccggtaaatcggttctcttgaaaacaattttggggttcattcgaccacaacaaggcaccgttgccattaatcaggtggtgatcgatccacggcgtccttttccagcaaagattggcgcggtgattgagcatccgggtttcatcgaggatatgagcgggtatgataatttgatggccttggggcgtatacgcagtcagcttagccatgatgaagtggttaacgtcttaaaacgcgtcggactggctgctgataaaaaaccggtcgcttcttattcgctagggatgattcaacggctcggcattgcccaagcgatcatggaagaccaggatgtcattcttttggacgagcccacgaatgctttggataaagatggcgttaaaatgctcactggattgctaaccgacctacgccaacaaggcaaattggtgctaattgccagccacgacttagcttggctctactcgttagccgatcacagttacgaactgacggatggccagctaaaaccagtggaagaggcgaatgtctgatgaaaaaaagcctaaaaatagccatgtttatcctcccaatgctcatattaattgggttagtcatatggcgctatcagcaagtcaatcaaccgattacccagcctgctgtcgttaccaaaacctatcgagtgccagcgcgtatcatgttggggcggcgtcaagtccggctgaccgcattcaaatgcaatgaacagaatggtgaatggcacttgcaattgcattttgctagcaccctgacgcatcaagatttagagcaaatgaccttcatgctgtcacaaaaacgaaaaggccgcgatgtcccgtcttcattacgaccggttatcagtgcggacaaacacacactgcagtttactaacccggtttatagcgctgccaatcaaaatcgtcttgccatcatcacgctgccaaaaagccttaacgagccaaataaaattcaaattattcaggctgagtagatcgcttttatgcatctatactgcatgaatgatgcccccgcctcgagcactcaaaaaaggatagacctagcaaacttgattgctaaatctatcccttttgttttaacgttcgaattcctcaaacctacttctgcagattaaaacaagtactgcaaatcactttgcgcactcggataagcatagatccggttgagatcactaggttcctgaccggcatcaattgcagcggcaaaagtgttgatgaggccttccgccagacttgcgaggacaacggcgcctgcaagtttgccggtgcttttatcaacaatcgtccatacctgcgcatccgggtcttgtatgcggttgtatgtgtaccaatgcgttgtctcgttgtgggtgacctgatactgttccggtgcggctagggcatcttcaagcgccacgccgactttagccagctctgtggggccaaagacaatggttggaatcgccgggtaatgaatcggttcctgactgccaagaatttgttgggctacatagcggccttcaaagccagcaaccggtgtcagtttcggttgaggttttaagttgacatccccaattgcataaatgttggcaaccgccgtccgtaagtgatcgtcaacgggaataccgcggaggtcggatttaatcccagcattggccaagcctaaatccgcaacgttggcaattcggcccatcgccgtaactgccatatccacattgagatcaaacctatctgcatgcaagtgcgtcatcgttccaagcggactgatttttgtcagttcaacattagggtgaaaatgaatcccggttttaagcaacagctgcttcaatgcctctgtggcaactttagggaaagcacgtaaaagtcggtcggaatgaccaatgatatgcacatctgctccagctgccgcggcaatgttagcaagctcgacactgacataaccggcaccaataaacgcaatgctagtcggtaattcgtccaagtctagaaagtcacggctggttttcaacaaattggcaccggggatatccggaaaacgcggcgtatgaccggtggcaatgacaatatgttcaccggtcacattttgcgacccgactttaaccatatgctggccgagtaattgggcccgtccgtataaggttttaatgccagtctgcgttaggccggttagcgtcccagccggaataccggttgtgtaactgcgcttgaaggccatgagtgacggccaatcaatcttagccgtaccactgatgccaaaaccgttcatccgcaaagtagcgtttttgacttcaactccgcgataaagcatcttcttgggatcacagccgtaattgggacaggtgccgccccacagatcgctttcaatcaccagcaccttttgcttggcggcaagtccgtaagcagccgccaacccaccgggaccgccaccaatgacaatcgtgtcataatcatacgccatttcgatcatcctttcgtttctgtgtcctgatcaacaaatgcacttgcaagatacgccaccacactatgcgtatcaatcacgaagacgccatggtcactcttgacccgcaatgtttcatgggcgtccaacaacggcagcgcctcggccaacgttaaattaccgccaactgcatgatcagctgattgctcaaccgcaaatggtgctaattgactcaatgtcacctgcaacccttgatttgcctgcgctcctttgaaaagatcagcaacaaaatcattggctggctgcgtggcaattgcttccggagtgtccacctgcaagagccgaccgttatgcatgacgccaatccggtcgccgagtttcatcgcttcagccatatcatgcgtgacaaaaacaaccgtggttttcattgcccgatgcaagtgcagcaacatatcctgaagctgggtccgtgaaatcggatcaagcgcggaaaatggttcatccatcaacaccactttcggccgcgatgctaaagcccgcaaaataccaatccgctgttgctggccacctgaaagctcgctgggcatgcgatctcgatactcgtctggcggcaagtcaaccattgccaataagtcatcggttgccgtgcggatcttttgccgtgaccaccctttcatttccggaatgaccgcgatgttttgcgcaactgtcatcgttggaaataatgcaatttgctgtaaaacatagcctagatcccaacgcaagtcacgtaccttgtatgccatcagtggtttaccggcaaatttgatgacacctgccgttggatcaaccagccgattgatcattttcaacgtggtggttttcccactgccggaagtgccgaccaggacgaacagttcaccttgatcgacctgtagactcaaatcgttgacaaccggcttgtcatcataagtcttcgtgacgtgttccagactgatcaatgccatcagcgcacctccttgagcaaaccatgttgcacgagatagcgatgagcgaccgtggccgctttttgattttgcacactcacggcataattcatcgcctgcatctgtttttcggtgatgtgattggctaaccggttcaacgccgcaaccagtcgtgggtgctgcttggcaaacgcagcccgcatgagtggtgccccgcggtaaatcgggaacagacctttgtcatctttcaaggccactaaatgatactgtcgcaattgcgcgtcagttgtgtagccatcagtcaggttgatctgcccgcgatctaatgcttgatatcgcaacgaggcatccatggaatccaccttaaattgcaaaccatattgagattgaatgcctttatatccatcttggcgatcaataaattccaagtcaaagccagcgcgaattgatggtgcgatttttgccagatcactgatagtttgcaactgataacgcttggcaaaacttgctttaaccaccagtgcgtatgtgttgttataggccattggtttcagataagtgaagccttgccgggccaacaactttttggctaatggataattatttttgcctgccgctacctgctgctgttgggttgcagagggtttcgtcagactagccaagaccgttccggaaaattctgggtacaagttgatcttatcggttcgcaaagcattgtacaagaagctcgtttgcccaaagtttggtttcaatgtgaccccaacatcaggatcggctttttgaatcagttccttatacatatgaatcaagatatccggctcgctgcctaatttacccgcaatggtgatcgtttctttcggcgcagtcacccggctgtaaacctgcgtgccgacgagtccgaaaaccgccaacgccacaaccccgacgctcagcttccagttaattttttgcatcaagttcaataaccacgaaaagacaatcgccaataacgccgcagcgagggcacccataagtgtcagtgcggcatcgttacggtcaatgcccaaaagaatgaaggttcccaacccgcctgcaccaatcaacgctgccagagtcgccgtgccgatgatcattaccatcgccgtccggacgcccgacaagatcaccggcagcgcaatcggcaactcgactttaaatagtttccgcaaccgactcatcccaaatgcatccgccgcttcttcataagaaggatcaatgtcgcgcaggccgatatatgtattctgaaaaatcggcaacagcgcatagaccactaacgcaataatcgccggcaacgttccaatcccgacaaacggaatcaataaccccagcaatgccaatgaaggaatcgtctgcaacacgccggtaatctgaagcaaaactgccgcgactttggcatgtgtctggacccaaaccgccaacggaatcgcaattaccaccgctaaaataagcgcaatcagtgatatttcaatatgctgtcccagtgcacttagcaattcaccgtggcgctcagcaatcgtccgccataaatcagccatctcgaacctccgtgtgaagtcattatgtttaagtgtaccaccttgttttccgatgcaacaacatgaagcaaagtgtagtaagtgtcaacttttctcggttctattctaattaagtgatttccgtgtaaggccctaaaacgcaatgactaaagcccagcatcacgcttaaggccgcttacgttctggtttacgcccataacgcgctcaccggcgcagaagtctgcgtgtaaggaccttaagcgcaatggccaaaaccgggccatcacgcttaaggccgcttacactccgacttctaaccgcgccggttcgcgctcactttacttttccctcaaccgggcgtaagattatcgacactattttaaacacgataacgcgttcgctggttcaggattcgatcctggtcacatcaacgcacgcatactgaatcggagaggagcgccggttatgaagaatgcaacgaaagcagaagaacaggcacgggtcacggcggtcattgcgaaactaaaagcgaggttggctgccatccatgagcaaatcgaagcggcgcaccgtgaaaccagtcgcatcgaacgggcatatggcgaaaacaccaaagtcaacgtgactgaagtcgatgaccaaatggaaaccaacgccgccgttcagcaacaaaaagtcatggttgcacgggcggttgaaaatgaaaccatccttaaacatgaaggcgatcgcttaactttattggcagacaacccgtattttggccgcatcgacattgacgaagacggcgaaccggatacgctctacattggcaccgcgaccttcattgacgaagatggcgattttctggtttatgattggcgcgccccgatcagttccatctattataacggcacgctgggggatgtgacctatgaaaccccagctggcgagcaacatgcgacattgaaaaataaacgccaatttcaaatcgaacacggtcatatcaaaaccatgtttgatacgaacgaaacagtaggcgatgagattctgcaatcggtgcttggcgaccagtctgacgaatatatgaaaaacatcgtcgccaccattcagcgcgaacaaaacgacatcattcgcgatacctcaagtgacttgctagtcgttcaaggcgttgcgggctcaggcaaaaccagtgcggtcctccagcgggttgcctacttgctttaccacagccgcagcgatttggatgccgaccaaatggtgctcttttctcctaaccggctttttgccaactacatttctcaagtcttgccaagcttaggtgaaaagaatatgcgtcaggccaccttgttcgagttcctcgccaatcgttttaccggcctgcatgtcgaaaccttatttgaacggtacgaacacgatgcagccggtttaccgcaagcagccgaaaccattcgccgctttaaagaggctcctagctacttacaagccattgccgattacgccaacgatccggatcgcgtccctcatttcattgacgttgaattcaatggtgaagtcttcttttctgccaccgcgattgacaatatttatcagtcgcaaccgaccttgatgaaacccatcgacaaatttaccgctactaaaaacgcactgattaaacagttaaacgctcgtattcacgacgaagccacgcacgactgggctcaactgcgtgtctctgacttatcccaaaccgaattagaaacgttgacagctgatcacgaatttgaaaccggtgaagacgagcaacaattcgtttccgaagccattgttgcaaaagccttcgccccgatttacgacgcactgtacaatgatcatttttatgacgtcttccaggattatcaacaattcatggagcaagtagcagctccggtgaacgtgccgatttggcagacgatgatcactgcttttagcaacggcattgaagctcatcacttacgcttagaagacgcggctcccttgctttatctgcgcgacctgagcactggcagcggccaaaatagtttgattcaatatgtgttcgttgatgaaatgcaagacttcagtatggcgcaattgttgtatctgaaacatgcttttcccaaggcgaaattaacgttgcttggggatgccaaacaagacgtcttcaccagcaattaccagcccagcgacttcatccacgaaattaaggatgttttttccggctataagatccgtttgattacgttgaacaagagttaccggtcaacccaaccgattacgaactttgccaaagccttgttgccaaaacacgaccacattcaagcctttaatcgcgccggagatatgcctgaggttttgaccgtttcatcggcggacgccactgcttccttatcgcgtttggtcacgcggttgctgacagttgacagtactgtggccattttgaccaaagatgccaagaccgctgcacaactttacgccacactcaagctcgatacgccggtcacgctactgtctgcaaacgaccacagtctgaaaaatgggtgtgtcatcttgccggtttacctggctaaaggacttgagtttgatgcggttgtgggctgggacatttccgcaaccacttaccggaatgaagccgatcgcgatattctttacactctttgctcgcgtgccttgcatcacttaacgcttgtaacgttggacgcaccaagcccattaattactgcattgccgaccgatctatatcggcgaaccggcgatgcctcggaagctcgagtttaaggctattggcagacaaacgcccttgtcgcaaaaagacaagggcgtttgttttattcgtgattattatgatattttattaacatcctcgtttaatttaaaaacttaatacaaactccggaggccatttgattgtgtaacttattacgcaccttcatggctgtctatgaaacgcgcagtttttcattggcggctgagcatctttttacgagtcaacccaccgtctcccaccacattcagcagcttgaacacgaactcaatgtcacactttttgaacgcaacaagcgcagcgccaccgtgccaactaccgcagctgatattctgtacgattttagcggcaacatgttagccgaatgggacaaaaccaaacaagcactgcaaaacagcacggcgacaaccacggtcaccttgcatattggcatatcccaaagtgtcgcggccgtgctgtttcctagcttagcgcgcgatttgaaggctgcttttccctacctacaattcgatgtagccgtcttaaattccctccaggttgtgaatcagctggaatcgcggcgccttgatctcggctttattgaacagccactgacacttaaaggcgctatcagaacgaccttgtgttccgatcagctcacggtctcgggctggcccaccggtacctggatcacccgcgaagaaggttccggcatgcgctattacacaactgcttacctacaaacaaccggcatcacacccaaacacctgatgaccgttaataacaacgctatgctgcgggccttggtccaaaatggcgtggggcaggcgctattatccgatcgcatcgctccgcctgacgccccgcagcaagccatcgggaaaaagtttcaacggcatttttatctgctgcagaaaccgagtactcactggccgcataagcaagcgatgctggataagattattgatctggctaaattagcaacaaaatgatgcgctggatttatgctgtttaaaggcagaaaaaacgtcacaaaagctgtctcatcgccttttcgactattcaataaccttctgcgcgtcttgagcagcagccttaatcccttttcgaatccgccgcagaaaatgcagataatgaccggttacaaagactagcatcagcgttgccgcgatccactcaccccattgcaggacactcatcagatcatgcactgtgccattctgggcaaaagccgcaatatatttggtcaatgcggtggcggaaatgaccaaagggaaagtgaaggccgcaaaacttggataaaacgacaaccgcgtatactgccgaatactaaccaacgtaatgaaatataaactctgcgcaaaaatcagcatccccgttgccagccagaagttaggatggtcaaaactggccagataaccggtcagacacagcgagtccggggctgccataatggttaataatggctgagtcgcttcgggcaaaggcacatgccgtaaccggtgaagcacaaacggaaacaaggcaacataaatcaccaacgccatccagaaaagcggctgacctagcgccggtacaaattgactgctggtcaccggaatcacacccaagccaacaaacgtgacaaaccagctcggataaatcatctgccatgctttcggctgtggaatcaaatgccgcaaaacaaagaaaatcatcaacccaaagtgaatcgccaccgccatcagccaaacaatcgtcgcaaccggcaacggcatcccccaagcaacaaaataagtgcacaagatcatcagcgtcattgaaaaagttggcgaaaccgaagcaataatcggatcctgcaaactaccagcagcatgaagcggcgtcaaacaaagcttcagcaaaaccaacccaaacaacaaccccgctacgatcccagtcaaatcaccaaccaactgccaaccagctaatttatacaaattccccaacgaagccaaccccaacgtcaaccccgccatgggtaacggtacctgctttaaaaaattacgcataacatcctcctgagcgcgaaccggcgcgcttagggatcggagtgtaagcggccttgggcgtgatggtcgggctttgaccattgcgaccaaggtccttacacgcagatccctgcaccggtgagcgcgttatgagcgtaagctggcaagcttacggatcggagtgcaagcagccttaaacgcactggccgcaccttgaccattgcacccaaggtccccacactccgattcctacgccagcaaacgcataatcaatcacatgctccccagtctaacaagaacagctaacatcaaccaaatgaatcttttgcatcgttaatattcatgaatcgaatattagcctcagaaaaaaagcgctggtaaatcaacctttcgctgatgccaacgcctatcgacttgttacttgccaccaggacgaccatcaatttaataaacaagctttttttcgaccaagttgattggaattagcgcaattagtaacaatacaacgaacaaccaaaccagattagccaattgaccactcaaattaccatcagctaatccgcgaattaggcccaccgcatgggttaacggcgaaaaccagccaacctgtttcaaccagctggccacatgattcaacgggaaaaacgtatttgaaaacataaacatgggttgaataaccaacatcgtgtaatagttcagataatctctggtgggtgccatcagtgtgaaagccagtcccaagaatccaaacagggtacctgtaataaacaaaaccattggaattaacattgcccaaaaactgctaatggttcccatcagtagcgccactagcataaatagtgtaccgaagatgacgctccggataccagcccaaatagcttgaccgacaatgatatccggcaggctgattggaccagtgctcatttcataatatgttttgtctaaatgcatctggatataggcattaaccgtgctttcattgttggacgcgttcatcgccgtcccagcaatcaaacctaacgtaataaatttcaagtaaggcatcccgtctacttgaccaacaaaactgcctaagcccaaacccatcgctaccaaatacaggatcggatcaaacagattaggaaaaatagagattttaaacaacttcttgaagctcatccaatcacgatagatcacatgaccgatgcctttaatcttgagtttgttcaatatcttcccgcccctcatcaaaatttgtcattttcaagtaagcctcttccagcgtggcataaccatactttagcggaagttctttaacaggagcttctgctaaagcgacgccatgatcaataatcataacgttgtccgccaacgtctcgatttcatcaacataatgtgacgtgagtaaaatggaaacaccgcgtttttttaaatcattgattcggtgccaaaagacatgtcttgattgaatatcaagcccggtggtgggttcatccagaatgatcagtttgggatcattaataagcgcccgcgctaagactaggcggcgacgcatccctcctgacagactggttgttgctttattttggtaatgagacaacccaacaaactttaacaattgctctgctttttcagctgcagttttaaccgttaaatcaaataagataccatgagcgatcatattttctttaacggtcagcgtcgtgtccagtaagtcatcttgcataaccaccccaatcgtccttttagctaatcgaggttgtttgacaatatcgatcccgttgatataaatttttccggaagtaatggcggtagtcgcataaatcatttttaaagttgtcgatttaccagcgccattaggtcccaagacagctaacgttttcccgcgatccaaggacagtgaaatgcctttaactgcctcaaagtttccataacgcttaactactttttcaacctgtaaaattttcacagccggacacctccactagcgaaacaaatatcgcttttcatgggcttaactaacgcccttgttctaaattttagggcgcagtcatttccatgcgcatcgaaatgtggaataattaaagtgcggttattattcgccgataaagaggttcgtttcatggcaaaagaattacctaacatcaccaagattgcagtcgctttgtccaatcactcaaaaatgctagttttggacagtctcatggataaacgcggtcacacgcttctagaaatagcccgcgaagccaacattcaacctcaaactgccagttatcacttacagaacttcattaacaatggttgggttaaaatggaaaaatccggccgctttcactatttcttcttagtgagtgatcaggttgccgcactcatcgaacaattcagtccactttcaccatcagcgtcaacccataccttaaccagagcccttaaggttgataaaatgcggactttccgttcttgctacgaccatatggcgggaaaaataggcgttttgattaccgatcaactcttggctgatcacctcattagcgaagaacctcaagcatatcaagtcacgccggatggtctgaacttctttgaaaaggatttgaatattgatcttgaaaccgtccaaaaaaagaaacgcctctttaccgttaaatgtctggactggagcgaacgaaaacatcatctcggtggtgccttgggtaatgccatttttgatgcattttcaaagcaagcttttgttgaacgtgatcccaacaccaaacgagcgctttatctgacagcagaaggaaagtattttctacacactgaattgaactgccaatttgaataaaccgaccggaacgtataaaagccacccatcgcagaacaatgatgggtggcttttatacattcattaacgcttttagcaattcggaatctgcccatagccaaggaagctcacgcggcaatgatcggttgctaggatcacgctgcttaaaccaataaaatcgtcgcgttattcagtatgtgcaaaccgattgaatagcgcatgtcccgcgtacgcaggtaggtccaggctaagacagcgccaagtgcggcataaataaaaatattgtagtcaatgcgcgaccccgccacatgggcaaagccaaatgcaaatgcactcaccaacacgctaacccactgccaggaacgtttctgcaatgagccaaagctattcatcaaaagaccacggaataaatattcttcgacaatgggaccaccgacgaccgccagcaatttaatcccccatggatacgtgtgaaccagtttaatcaaattactctgatttgctgccaacggtgcatcggttaattgcataatgagtgaattcgtcacctgaatcaaaagcagtaagccgatgccttgcaagacgaccgcaacgggatgggcaacttttaaaggcgattgctgacgatataaacgccggtaacaaaccatcaaggcggcaatcaatgccccgaatgcaatgataaacgccgcgatcgcaccgaccatcccccaggttagttcgctgcgaacaagtgcaagttcggccagagagtagaacaagaaaccgacaataacgccaaaaatttgaatgatggaacggaggatttgcaaaataaacgatcctttcgtaggcagtcacttggactgacggataacgatgtcacaacattgctagcaacttataataaaaaaagcccgaccagataactatctgtcaggcatttcatttgcagccgtctatcgggcttgaaccgacgacctcatccttaccatggatgcgctctaccgactgagctaagacggcaaatgacttggttgtttaaaaacaactgcctaattaatgtacactaaatcgccattccccgcaagccctttttggaaaaatatcgcaccaagccattttccaactgcaaatttcaagctgttagcaacgtcaacgggttcaaaccgttacaatctgatcaagctgatctttaatctccggacgaaggttatgggtcaccatgatcaatgtggtcttgggtaacgccaccagtaatttttcgatggcgagtcccgacttaggatcaagcgccgccgtgccttcatcactgatgatcacgtggctttggcgaatgaggccgcgcgccaaggcaatccgctgtttttggccgcctgacaagtctgccccattatgttccaagaccgtatcaagtccctgttcctgttgcgccataaacgttgtcagccacgcagcttcaatcgcatgctgaaccacatcatcagctacctgttgtcccagcgtcaagttaaagcgaatggtgtcgttgaagatataaggtgcctgatcaatataggtaatctgatcccgcaaagaacgcggatcaagcatctgataattttgggcgtcccacgtgatttgcccttgataatcggctaatacatcactaatcagtcgcaacaaggtggttttcccatggccggatggtccgacaatggcaattttcttacctgccttcaacgtcatcgtcacatcattaagtaccggctccttgcgatgcggataggtgaaagtgacatcctgcaaatgaataccttcctccaaaccattaactggcactttcggtttttgcggtgctggaattgctttggcaaacttatcaaaaatcggtgcgactgatttaaccgtggtcaaggcaaaactcatcaaggttaagccactgaaagtcgtcccggccaccgaatgaatcgtgacaaccgccccaaccggaatcacgcggttatacgccagcaatccggcttggatcagcaagaaaagttgactgcccagattcaccaaattgatcaaaaattgcgtggccatattgaattgaatgtaccccacttgtgcgtgtccggccgcattcgatgcatgaaacacccgatccaccatgacgtgacgccgattcgccataaataaggtattgaagccttcaagaatatccgtaatccgattggtcagtttctcgttttcctgactccattttgccgccgcagcgcttagctttttacgataaatcatcggaaccgtgatcaatagcaccgcacaaaccaaggtggtggcaaataacgatgcttgataggtcaatagcacaagaatactaagcacaacttgccagctcgcctgaatgagatagcccacattgcgcagtccctgggtattaatggtattgacatcgttggtcatccacgaggtatacaccgcatccgaccgcgcatggtactgttcaaacggcatcgcagcaatgctctttgttatttcggtacgaatgtcattattgagccgccgttgcagtgacacctgataaatattggtcagcgtctgcatcaccagttgaaagatagtcgctaccaccatcacaatcgcagcagtcacaaaggcatttactttaaactgggtcaacgcagtaatcatattcccagtaaaaattgacacagcagttagcgcagaaatttcaagcccatacatcaagataaacacgccaaaccgccacttaagccggaaaagatattgtcgaaacgtcacagctgcatcccctttaaaagcacccatttaaagttggaaaataatggttttcaccatgctgtccgtattaggcacaccgcttcatcgccagacaatgtttcatccaacaccaagcgttgcagccaatttccacttaattatgagtcttttctgagcaagattagaatacccaaataatagcattacattttcagaaaaacaatcgcaccattagcgttccccctgccactctgctttaaattcgtccaaaaatgacagcatcacttgctgccgatactcagcaagctgtctggctgccgatgtattgagctgatcctttaacttcaatagcttttcataaaagtgattgataaccgtgctatcttttcctcggtagctgcttgcggtcagggtcgttcttggcgccagtgccggatcatacatgcgaccgccatgcgcaccggcgtacataaacgcgcgcccgattccgatcgcgccaatcgcgtccaaccgatccgcatcttgcaccaactgtccttccactgataacggttgatgcttgcttaaatttgctttgaacgacatgtggtcaataatttctgtcactgcctgaatctgcacctgcgtcaacccagctgtagccatcgcttgctgtgcggctgcttttgctgcgccgacatctgccaccaacttatcgtcataagtatcatgcatggttgccgcagccacgacaaccgttgcatcaacgcctgctgttttggcaaccagttgttttgcattcgccaccacccgttcaatatgatcgaagccatgtccactatgatcctgcgatgaaactttttgcgcatataccgtcaatatttgccagtcaatcacgcttcaacactccttagctgataatcatcaaaaattaatgtgatgccatgaacaatttaactagttatccgccctaattgttgcgccccttaacctcaagagttcatacttaaagtataaagaggttatgtaaaaaagggggaacatgacgatgaaaaagcaatatttgtcggccagccagtcggtcaaccaatttaatcggcttttttcaccggtgtcaacggctgacattccattgaatcaacaaaatctgctcttttggatggcaaccgattcgacacctcgaacaccaacgaatctggccaaagaaatgcatgtcaccaaggctgccattaccaaagcaagcggtccactgctcgaacgcggcctgctcgacaagcaacccgatcccgaagactgccgcagtttcaaactcgtactaagtgaagccggcgaaaaggctgtcgaagacttgggaccggaatatttaggcaacctcgagcgtctgtacaatgagttaggtgaaaagaaatacctcaaactcatcaaactgctcagccaggcaaccggcgtcacggtaaaagaatagttcgtcacccatatttgtaaaatcgcatacgccttacgcatcaccgcgtaaggctttttggcatattccgataaatttgacgccatgcttactggcgaatgacaacactgcgaacccagctgtgtgccccaagttactttgttcgtatgtaaaaaatagaaaacaagagctggcggagcggtggcgggctcagtggtgaaattggtcttaagcggagtgggcttctccgctttagaccaaggccgagctttgaaaccgcgcatgcactttgcgggttcaaagtcgtgcccaccactctagctgcgcggtcgccatcctgccaccgcggagccagctcggagtatcggaaatcacttaattggagtagaaccaagaaaaagttgacgcttaacctaatctaaccaaatttgcccccttccccagctgcgttacaataaactcatcagccttttcaaactgactcaccgaaacgttttgtctgccaaaggagcgtgttgcaatggcaattccagatcatatcagtgttcggggcgcgtatgtgaataatttgaaacatctcaacgtcgatattcccttaaataagcttgttgcgatcaccggccgatccggttccggtaaaagctcactggcaatgggcgtgctgtacgcagaaggcatgcgccgctacatgagtacgctgtccacttatactcgccgacgcttaggccaaaccagcccggctgcggcagattcggtcaaacatattcccagtgccattgcgctcagacagcggcctgttgttccgggaattcgctcaacagtcggcaccgcaactgaagccctcaacgtcattcgcctcatgttttcgcgcctgggctcacctgtttgtcccaatggtcaccgcgttccaccgacactcgatattgccaaagcgatggatctgcctaatgatggcgaaagcggcatggggatgatcacctgtcccacatgcggtgtccactttatggcatttgcggctgaagattttgcttttaactcaacgggtgcctgcccaacctgtggcggtacgggacaggcgcggacgcttgcggccaatcgcctcatccctgatccaactttgaccattcgccaaggcgccgtggcatcatggcggcttccgggacgcaacttcatgccttatgtggctcaagcaatcggtattgatattgacacgccttttcaagacttacccgaagaccagcaagaacaggtctggcacggccaacgcaaaaagtatgcgatcaacattccaagcaaaaccggcaagattttccacatggatcacgcccaatatgaaaatgcttttaatgccgttgaagattcgctagccaccaccaaaaacgaacgggcaattgaacggttaaatcgtttctatgaattcggcgtttgtccgacctgccacggcagccgattcgcacccaaactgttagcccagcatctggtcgatcaaaacatcgcccaagtcagcgacatgacgctcacacaactaactgctttcatcccgaaaatttaccagtggctgccagctaacatgcaagccttggcgcacgatattatcaaagagctgacccaactgcttaaaccaatcatggatctaggcttaagttacctcacgctgagtcgggccgctgcttcgctttcaaccggcgaattgcaacgcattcagcttagccgcaccttgcgcaccgaaacaaccggcgttctttatgtccttgatgagccttccatcggtttgcacgctgccaatgtcgccggtttattggaagtcatgcatggcttggtcgatcaaggcaattcgttagtcgtcgttgatcacaataccgccatcatcaatgccgccgatcaaatcatcgaaatcggacccggagccggagctgacggtggccagattcttgatcaaggcagtccggccgaaattagtcacgatgctaagtcgttaatcgcaccgtttttaactggcaaaacgcctttaatcgtccgtccacaagccggcagtgcggccattgccaaagccaagcaactgcatctcacggtcacgaatcggtttaatcttcatcatctgaacgtccaattcccgattaattgtttctcggtggtgtccggattctccggtgcgggcaagtccaccttgattttcgatgcgctagtgccggcactttccgcaaccaaagatcagcctgctcccacgtttgtccgcgatctaaaaaccggtggcattcggcatgtggtcgccattgacgcgacgccggttggcaaaaatgtccgctcaacggtcgccacctacaccgatattctggatcatttgcggcatcttttcgccagcttacctgctgctaaggccaagcactataccagcagccatttttcttacaatgtcaaagccggcgcctgcccaacctgtggcggcaccggggttatcaatctggacatccagtatttaccggacatgcaacaaacctgccccacctgccacggccgacgttacaatccagaagtgttgaaaatcaaatggcacgagcggagcattgcggatttactcgacctcgatgtggacacagcactcaccgtttttaaggacgaaccgaccatcgtccacaccttacaaaccttgcacgatatgggcctgggctatttgcatcttggcgaaagcacgccgacgttatccggtggtgaagcgcaacgcctcaaacttgttgcccacatgggacgctcgcaaaaagacacgctttttgtcttcgatgaaccttcagtcggtctgcatccgctcgatgttcagacccttgtggcggtgttccagcgactgttacaaaccggcgccaccgtcattgccattgagcacgacttagatgttattgccaacgctgattacgtcttggacctcggaccaaaaggcggtgcagaaggcggacacgtcatggcagccggcacgccgcaagccattgccaaacaaggtcatggagaaacggcaaaatatttagcggcacatcttgctgcttttcatgtggattgagagcacctgtcaagcattgttcctcaaaaataaaacagctccggagtcaaaaaacactccgaagccgttttttatacttacgcttagccttttacagccaaacgtcaactaagcatttaaaatatcatcaatttgttgaatctcttcagcagtaaaggtcagatgttccgttgctttaaggttatcctgaaggtgttcaactgaggtcgtcccaatgatcacacttgtgacaaccggatcccgtaacaaccacgccaaggccatttgactcagggtttggtcacgatcatgcgcaatttcattaagcgcatttagttgcttaaccacagcctctttgcccttagcaaaagtggccttgttggttggatggattttgaaagtatccggaattccctttaggtagcgatctgataacaagccttctgataacggtccgtatgcaatcaacccggcaccatcagcttttaatgcattgatcaagccggacgtttcagcggtgcgattaaacatgttgtaactgtattgattcagtacaaaaggcgtgtgcaaatctttaaacatcgcaattgcttctttggtctgcttcgtatcatagttggaaataccaatatacaacgccttaccgtcacgcaccgtttgatccagcgcatttaccgtctcttccaaggccacggtatcgtcaaatcggtgggcatagtaaatatcgacataatccaactgcaagcgcttgagtgaatcattcaagccttgaataactgctttacgcgacgtcccgacaccgtatggaccagggtgaatctcataacccaccttggtactaatcaccaattcgtcccgatacggttttaaatccgtggccagaatctgccccagtaacctttcactagagccaaatcccggttcacgatcaccattaccataatgattagcgacatcaaaatgaaaaacgccacgatcaaacgcatccaaaatcaccgaacgtcgcgggccaaatggatccaagttgccataatgctgccacaatcccaacgaaataaccggcaacatcaaccctgtcttaccagcatggcgaaccggcattttctcataacgatcagctgctgcatgatacatcattaacgccctcctcaaacgaccgcaaaataaaaacgtttaccatctctatggtggcaaacgtttcgctaacaatcaaccagaaaccccactttttacggaaaaagctcacttctcaaaaaaatccgttaaaaagttcgccacgccgtcatccacattagtatcggtgacataccgagcaacacgtttcacttcaggcacagcattacccattgcgacactgatcccggcagcttgcaacatacccaagtcgttcaagccatcgccaaaagcaatggtgtgcgcagcgtcaatgccggttttcgcctgcaattcacgcacggcattggctttgtcgacatgctgaggaatcaattccagattcgtgtgttcagacgcagagacatgcaaaacgttgcgtgcctctaatgcggtcttaccggctgccaatgcctgtgagtcactcggtccgaaaataatgccattcgtgattgttgcagcatgggttaataatgccgctgctgacggtaaggcaaccacctcgatcgcgactgaactcggtgcaaaccgccgcgctgctgcttcaatcgctggcggcaaggttccggtgaaataaaccgtgtcatcgctgaaatacaacgcattgagtccaagatcggttgccacttcttcaaccgcagtcaacgccgccgcccccaatgtgtgatggacccgctcaccggaaaagtcataaaccgcaccatttgacgcaataatgttggcataaggttgaaattgatgggcaaccacttctgccagtgcatgcatgcgccccgtcgcaacgtaaaacgctgctccggctgttactgcattggcgattgcctgcgttgtcttttcggtcacgtcatgatgattggcagtcaatgtcccgtcaatatcgctgacgattaaatattgcgtcataatgttcctttcttgtctgtaaaccatgctgcttaccgtttagccgttgtagatcaaagtgctgatgataccaaatcagccatagaaactggattcgtctctatggctgatttaagcctgatctgcctgccatctaaaaatcgtccgaaaacaatgcgctacttaatggcacccagcttcatgcgcttgattaaagtccttgcggcaagccttcaatttgatcggcataccatttagcccatggtgtttccggcgccccttgagcattgaatgtgacattgacctgtttcaaaagatccaacaagttgccagaacgatgtgtcagtaacccactcgttaactcctcacgcgtcaacgtgcgattatcaagaagatagtggttaatatccgccaaatctccttgctcatctagttgagaaaaaacatcgagcccgtcaccaaagaaccgactcaggtaaaacttagcaaaagtctcaagcgctgtcttttgtgctgcttcatttaattgatcaatcgttgtgttgctagttgccatgactaatttcgtcctttctattttattccattataaccacttttcccctgcttttggaaagcaaactggtggaagagcgcgagccggcgcgttatggtgtgccttactcatcgaagtcaagcgcctaagttcaaaaaacatataaatatttttaactttttgaaactttccaccttttgtaccttgatattgagcaacagttgttatagtatgccacttatgttgggaattcaggaaaggttggaggcattatggaaaaagaaaaattacatcttggtgacgcggtggtctgtcaggttaaagaagacatggaagccccttttaccggtaaaatcgaaaaagtctacgaaaattcggcactcttgacgatcactgactacgctgatcaagaccgtcagaacgcgtcagaacttaattttaaaattgttgcaaacttccacgctatgaccaaaaaccttggcggcggaactgtcttggcctttccaccagaaacagaagaagaccgaaaaaaataatggcttagatcacattcagccagtttcaggccgcatgacccgtgcctaaactggttgttattatttacttagtcatcaactcataaaacaaacaaagctttcctggcgagtagattctatgctcgccgggattttttgtttaaggtcaaaccgttttcagcttagaacaaacttaatttcaaacatcaacttcaaaacggtttaagcttaaaagtcactttcattgtcagctggccaaacttgcgtagaataaaatcaaatagtaagcaaacgaggcgaccataaacatgcaaaccaccacttaccccattcacgaacgcctgctcatcggcaccttgctcaccgctgctgccggcagttttgatgcgtatacctacttgttgcacggtgaagtctttgcgggcttacaaaccggtaacgttattttgcttggcgtccatcttggccaaggacagtggtacacggcaatccgctatctggtacccattctcgcctttatgtttggcaccatggctgcacgcgccttgcagctacatgccagtcatcgctcccaaccgcttgccgaacaacggtggatcatccgttatgaaattgcatggctgttggtggtaagtctcttgggaaaatggctgccagatttagtggccagcgccagcgtctcagtgatcgcggctgcccagctacaagagttccgtcgtttaaaaggtggcccatttacgtcactgatgatgaccggcaatctacgcaccgccgcgcagagcctgtatgacggctttattcgcggacaacaaaaaggccgcgcatccgcagccactgtcggtacgatcatcttgagttttgcccttggtgccggggtcacgggtatcctgacccacgctatcggcacctacgccttggctggggctacgctggtgttgctcctgattgatctgttgctttggcgcgaccagaaaacattgccgcaacgcacggcttaaccaagcgcttcttgcccatgatgcagaaaacttagatcgttgaagtccgtcacccgaaagcggtcattaagccacattagcttagtgacactcgcattatccagcatttcgcggccatcaatgttgtagtggatatagttcaaccacattaacgctgccgttccgtgtgacaccaccaaaacgcgttcccatcccttggcctcggcttccacggcaatggctcgcagcgttcggtccaaccgctcctgcaccattcgattggtttctgccgggtttggatgctgatccatattagccgcaaatgccgcatcggctgtttgcgctaacgtaatttcgcgattggctaaggcatcatggaagttggcaatgcccatggtcgccagcgaaaagtcatttgccagttgcccttcgaacttgccataattttcttcacgcaagcccatgagtcgcgttaccggcagcggttcacccaaaccacttaaaataaaatgagcagtatcgacagcccgcgtcaagtcactcgcaaacgccgcatcaaaatgcacccctgccagttgaaagccgcgtcccagcgccttagcatccgcgattccttttggtgttaaggccgagtcagccattccttgaacccgtttttgcacattgaattctgtttgcccatgacggacaagatatagcgttgtcatgatcgcaatcccctaattttcatttatttccaagtcatcgtcattaagccagttttaaataatccgctaagtaatctgccatcccatcgtgatcgttatcgcttggtgtctgcgcgtctgccgcttcaagaatggctggacgcgcatttttcattgccacgccatgtccggcaaattgcagcatgtccaagtcattcatatcatcgccaaacgcaatgatatgtgcctgatcaatgccataccgctgagcgacatacgccaacgcccgcgacttgctcgtatttcggctagtcacttctaacgccgtatagtcgccactccaagcgccccaggttttggctgccaaatgcggatacaaagccgccacttgttgcgaaaccggctcaaacgtcttagcttccataaacatggtgaccgaaatcggtgcctgacgcaacccatgctcatccaataaagcatcagggtgtaagcgatccggcaagaacggaatattggcataaggccgatcagccaccaatagccgcttaccttctgccaccatcactttaaaggtaaagcgttggctgagctggcgtaacgataacgcaaccgaaatcggaatcgtgacttctttttcatattgccaatgctgatgcggcacatgaatcaaggcgccgttgaaattaatcatcggcccctgcaggtgtaacgtatcataaaactgttcggaaatcgcatccggccggccagtcgtaatcacgaccaaatgtcccgctgcctgtgccgcccgcaaaaccgcgatcgtgccagcactcagctgaccttcagtgttgagtgtcgtaccatccaaatccaatgcgataagataacgttccatgcagcagcctcttttcaatctttttttaaataaacaaacatagccattaccaccgcattcccctacaatagatagttagaaagcgagggtatcatggctgaatcaatcgtactatatactgacggcggtaatcgcaacaccggcaatcacgcaggcggctcagttcggcccaccgacaaaagcgcgtgggccgcattactgatctacggcgagcatgaaaaaatgctctctgaaggcgattacggtcggaccaataattatatggaaattatggcggtgattcaagggctaaaggcgatcaaacgaaccgatattccgattgacgtttactccgattctgcctatgtgatcaacaccatgcaacaacgctggtgggtcaagtggcaacaaaacggttggcgcaaccacggcaaacctgttaaaaatgctgaattatggcaagcactgctccaccaaatgaaccgtttcgatcaagtaacctttcataaagtcaaaggccacgcaaccaaccgcaataacaatcgcgttgacgaggcactgaaccaaacgatggatcgcctggacgatcgcacctgatcattttacccttgattgccaagaaaagcttccccataagtttccgccaaaaatgtgtgaatcacctgctgcatccgctggacagaaggtgattttttgatggtcggattaatcaccaaacacaaggttcgtgcgaatggttcggaaaatggatagacgttcacatcccccaccagcttctgcaaggcgagcttcggcaaaatccccaagcccagccctgattccaccatggatagaatgctttggtcatcaatcgaatagttgatcgtgttggtcgacacatgataacgatccaacgcattcttggtatcacgatcatagtcgatttgttgcaaaataaaatttcgcttctcaacatcggcttgcgtcacggttttgccgtttttaggcttgaagcgttttggtgtgatgcagtagatcggatcttttaacaacggctcaaccaccaccccgggtccaaccggcagcgatgaaaagcccatgtcaaccgtacctagtcgaaccgcctccacaatgcggttgaaggtcccttgaatgacactgatttcaatgtgtggatagcgcttcttaaaccgttgaataatcgtcggcagccagttagtcgaaaccgatgaaaacgcaccgatccgaattctgccggtattgacgccattgatgttatcggcgacttgcgacagttgctcttcaaggttctgaatactttggataatcggcagcacctgggccccatcttccgtcagtgtcactccggtacgattacggattagaagtggaaaccccagctcagtctccagctgactgatactatggctgaccgcactcggcgtcacatttaattccgctgcggcttgggctaacgtgccacgttccaccactttactaaagacttcataagaaaaattacccatgttatcacttttccccttttttctacttgatccaagtgacacgcgttgtcacttgagccgcacaatgcctgtcaaatggacgctgaggcctgtttgttgattttaacatgaacaaaattcaacttaagctgaaatagttgagctttactcaatcatacgagccgttttacactagtgtcaataagaaaacgttggttgaacttttaccaacgcgacaacggtatcgcaattaacgtgtggatcggcatcaggttcggttacacgcccgatatcaaagggggattcatcatgaaattcgcaaaacgtacccaaaaaaccggcaattccggattagaagatctgttcgccgcatctggcccgaatgtcatctcgtttgcaggcggctacccggatcggagtttgtttccgacccaacaactgaatcaggcatttaagcacagctttaacagtggcgatactgaactgttgcaatacgctagcactcaaggctacttgcctttacgcgaaaagattgcggctcggctgcgcgcaactggcattccgactcgtgccgataacatcatgatgacccaaggcgctcagcaaggactcgatctagtggcgcgcctcatgcttgatcccggcgatggcctagttgttgaagcgccaacgtatctcggtgccttagccgcctttaatgcttatcagccaacttattatgaaatcccgatgcaagacgatgggatggacattaatgccttacagcgcgttttaatgagtcacaaagtcaagttcatctatacggtacctgattttcaaaatccaaccggcgtcgtaatgtctgtggctaagcgtcaggcgctgattcgactcgccaaccaatatgacgttatgatcctcgaagacaacccctaccgcgatcttcgctatgatggtaaaccgctgccaaccattaagtcatttgacacgcaaggccgcgtcgtttatctcggcagcttcagcaagatcctctcaccaagtctacggatgggctggctcgttgctgcaccggaccttttgcaggaattactagcgttaaaaggcggaagcgacttggaatccagcaacctgaccatgcacggcattgatgcctacatggcggaaaatgacttagacgcccacatcaccgaaatccagaattgttgccgcgaaaagaagaatgccatggtcgcagcgatgaatcgttaccttcctgatgaagcgcacttcaccaaccctgatggcggcttcttcctgtggctcaccatgccagccggcttcgacatgggtgccttcatgaagcaacatctgttaccggaaagcaacatttcctatgtgccttccgccaacctatatgcaacttcggctcaggtcaacggcgcacggctaaacttcaccggtccgacacttgaacagatcgacactggtatcaaagcattaggcgatgcgctcaaaaccgcgctgcagcatcacctagtagccgaacaagcttagttttcttcgtcttaatctactcaaacctttacaaaatggcaaagtaaccatcacactttcgtcacactttgtcagtagtataggaaacatagaaatgagccacccactcatctctacaccccaacctaattttcatttttctcctccaaagaaaaataagatgattggcccccatccaatcatcacaaaaacgcccgctgccaatacgcaacgggcgtttttgtatcatgagcgcgagccggcgcggttagggatcagagtgtaagcggccttgggcgtgatggcccggttttggccattgcgaccaagttccttacatgcagatccctgcgccgggaagcgcgttaacgtaagcaatggcatccaaatcaacattcacgcttaaaacgatggtattcccgaaatatacttattagcaatcgcctcagccatgccttccagatcaaacagtaccgtccgctgtgctaaagtgagctgatactgatggtcgcgcatctcgtctctgatgaaatacccaatcggtaagacttgtggagcaatattaactccttgtatccgtttatccgccaccttatcaatgacctgtttgatacttgcaacaatagcttgcgatgtcacgtcggattgttcctcgaaaagatgttgcagttctagcatctttgcaatgagttcttgtttcttttccattttggctcaccccttcatttgtgaacttatcgtgttcaataaaaaaatttgactcgtccgtgtttctttatgcggtgcaatgatagcggttgcatttatcttagaatcctctatttggtttggcaagcaataacatatgtgcgttttgaagattttttgacgaacatgacacttgaacagtcaccttgaaaattagaacaatccgaagacaaaatgctttacgagaccaatttcctaatatatgctatagccaatttcagacagctatgcacatggagattctatagtccatttttctatacctcgtttactgacttaaaaagactagtaaacggtcaatagcaaagagaggcgaatgatcatggaaacattgtataaaggccaacctgctgatgtttgggaaatcaccaaaacaggcgctcagccagactgggtaaaagatgcattttcacaaaactatctttattggttggataatcgggttcgtattctcatgtgggcgttaaccccacctaacaagaagaatttaaagttcgttgctagcggttcacttggaggtggcgttgatgcactgggtgtttacgcatacggagattcaggtgacttcttggatgcaaccaatcaacgcgtggtatctcgagaaagattcttcaagcaatatcaaattctaaaatccaacgaagcataaccaattaaaggcgcgtgtattaacgtttgttgacatgactgtattattgttctgttggttcacccgaattcaagatccatgataggtgcaaccgtgatgaaagtttttgtgaacaatcgcttggctcttttcctatcaagcaaaagccgcaaccagactcacatcatgtgtaagtctggttgcggctagtacgtttacgcatattttaaactaaacggtcaaccccgaagctggatggatcatctttcttatcatccggctttttgtcggttgttggtttctcttcaggcttcttgtcagccgttgttttctcgtctttagcagtatccttcttttcgtcctcttcttttggcttcggtgcggactgctcacggatcttggcttcgatttccttggatacttcaggatgctcatccagataatgagacgcattgaccagaccttggccgaggcgttccttaccatagttgtaccatgagccggacttggtgataacgtccagatcgttgtctttatcagtcgctaagttgatcatgtcagtattgtgctcgatcccatgaccaaacgacatggtggtttcaacggtcttaaacggcggtgccaccttattcttggtcactttgagcttgctggcaaacccaacaacattcttaccatctttaacctgctggcctttgcgtacttcaatgcgcacagaagcataaaacttcagcgcccggccgcctggggtgacttccggattaccgaaaacaatgccgactttttcacgtaactggttaataaagatgaccaacgtattcgtattgttaatcgtgccggccatctttcgcagtgcctgcgacatcagccgtgcttgcaagccaacgtgactatcaccaattgcaccctcgatttcagccttaggcaccagtgcggctacggagtcgatcacgacaacatcaaccgcggccgattcaatcagcatctcggcgatttccaatccttgttcacccgagtttggttgggaaagcaaaagatcgtcaatgttcacgcctaactcagcagcgtactttggatccatcgcattttccgcgtcaatataagctgccttgccaccggttttttgtaattcggcaatcgtctgcagcgcaatcgtggttttcccactactttcaggtccataaatttcaacgatccggccccgcggtaagccaccgacaccaagggcgagatccaatgacagaatcccggttgagaccacatcgatcttcaactccggtcgatcacccatcttcatgaccgcgccttcaccgaacgccttggtaatcttttgcagcgccttttctaattcggtctcacgatctgtggcatcagacttcttattatcagcttttgtggtcgtttttttcgccatacttgtctccttaatgtcgtacatacttcgctcaaaatacactagttacattatcgaacacgcgtttgttttttgcaagtcttttccgtgattgaaacgccttttctgcactttaaaacggttatagttctattttacctgaaccagtcaaccaattggtaaaaacctgctgttattgatcgccgtaaaacatgctatgatagttcggttaagagcaaccagcatattgaaaaggtgagggaaaatacatgatgttcatggggtcaatcgttaacggcttaacgattatcggcggcagtttactagggctgatcctgcacaatatcagcgccaatgcaaaggacacgattacgaaaagtttgggtctgggtacctttgcgcttggcattcaaatggcgttgcagaccaaaagctttattgtgatcatcatcagtctgtgtctcggtggcttgctgggcgaatggttgcatattgaagacggcatgaatcacctcggcctcaagttacaggaacgctttgcccgcaacaacagccattttgcggaagggttcgtcaccgcgactttaattgccgtcatcggtgccatgagcatcttgggggccattcaagccggcgtgtccggtgataatgcgaccttgtataccaaggcggttatggatggtttcatggccattatgatgaccgcctcgctaggcatcggcgttttattttcggccatcccggtgattttatatcaaggaaccatcaccctgttagccagctttcttgtccagttcatccccaaaacgttgatggcaacctcacttcgagaaattggtgccattggtgggttgatgatccttggtatcggcctgaatctcatgagcatcaccaaaatccgcatttccaaccttttgcctggtctggttgtcttaattagcatactaaccggccaatattttctatcatagtcagtcgcaacaaaaagcaggtcaccatggcctgctttttgtctgaactttttgttgccatcttagaagttcggcagcagtcgttgttttcgactctgaaagcgatgatacaccaacttgcagtgccaatcgcgaacatttgccaaaaaatgcgagttggcatcgtgataccaataacgcaaatcgtctttgatatacaagcgattcaaccacgcgtgatcgtgccgcaaaaacgtaaaactttctaacaaatcctgttcgcgccaaacatcaggcaacaaaaactgactgcgcgtaaagcgttttaactgacggcttgaataatagacgcgctcaatgcgaccaataaagaaagccgtcttccccttgcccacgtacggtgccataggtgcaacaatcaatcccccgcgtaaccgctcaaaccaatctgtttgcggacttactttgattgcatgcgtaatatctttgggtagccggaagtccaaaaccaaaccatccgggcgccgtacccgagccacaatatgctgtttcttcacattaacaccccatcatcttggccaatttaggcgacttgagctgttgggaagagtttaccacgaaatgttcggatttgcatgaagaacgtttgtttcgttaagtaacgttcagccaaactaacttcttaagcaattccaagccgatttggaaaatgtgaacataatcgccataaagacataataaaatgttggatttgccttcacaattcattcacaccctgtctgtagtataagaaacatagaaatgagccacccactcattcctaaaccccaacccaactttttcatttttactcctccaaagtagaaatcgtcgatcgtcccccaaacgatcagacaacaagcagaccgcccacccagcggtctgtttttgtgtgagcgcgagcaggagcgcttagcaatcggagtgtaagtggcctcaagcctaaatggctgggctttggccatttaggcttgaggtccttacacgtagattgctgcgactgcgagcgcgttatagaaagcagaataagactactgaattgcccaaaaaaaaatacttctgtccctgctgcaattttccatccatcaacaccgactttggccatttaggctcaaggtccttatgtgcagattgctgcgactgcgagcgcgttatagaaagcagaataaaaccaccgaattgcccaaaaaagaatacctcttccccgttgcagttttccatccaaaaactccaacgttgaccattgcgactaaagcccttatatacaaattacgttttaaaccaccaaccctccccaaaaagaaaagcctcctgacaccatcgtcaggaagcctttcttttttaccacaaactcacaccttaccgcttaaacaattcatacaatgcatccggcgtcttcgcgtcctgaaacgccttcacaaaatcctcatgcgtcagtaacttcgccgtactcgacagatatttcaagtgactgccactatcatgttccggaatcaggaacgaaatcaccgcattaaccggcttcccgtcaaatgtttgccattcgactggttgcgccagatgtaacacgagcatcgctgaacgtttaatcgttgcatcttgtgcgtgcgggatggcgatgcctttttccatccccgttgagccttctttttcacgtgccacatacttgttgaacacagcatcggcatcagttgccaagtcgttttttactgccatattagccaaataatgcagcacatcatcccgcgttttggcaggaacattgacttcaatgtattctttgttcaaaatctcgctagggtcaaaagtttgctgggattgatccgcagccggagccggttgattgcgagctgatgaaacggccacgtgcgcaaccggttcgtcagcggctgccccttctgttgccaaggcagtttcaaccacaccggcgttgacaccacgttttttggcagagtggccggcaatcatggccaaaagcacaccggatgctgctgcaccgactaaaatccaggcaacccatagaaccggcttattcaccagtagcaaaacaatgaatccaccatgaggcgccggcacctgaatccgggacatatatgtcaaaacggcagcaatcgcggagccaaccatgaacgccggaatattcattaacggatttttcgcggcgaatggaattgccccttctgtaatatgggttgaaccaagcaacgcattgacataaccggcgctgcgttcatcacgattgtaggctttgggattgagtaataccgagattgtggtagccagtggcggcgcaatgcaggctgctgaaacgccggccatgaagaaataattgccttgtgccaacaatgccgtcccagtgagatacgccgccttattgattggtccaccaaagtcagccgcacacatgaccccgacaacaatgcctaaaataattggactggaactttcaagcccttttaaccacgccattaaaccgagattcaaggctttcatcggggtattgatgagatacataatcgatccggaaatgaagacaccgagtaccggatatagaaaaatggcttttaatccccgaaattccttgtcgggcatgaaggcgaacactttttgcaacattaaaatgaccagtccggccatgtaaccaccgacaatcgcgccaagaaagccggatccttgaccgccattgtaagcaatcatcccaaccgccatgccgacgattaagccagaacgtttggccacggcttcaccgatataggccgccagcactggcaccatgagtcccatggctgcactaccaaccgaattcaacatggctgcgaactgattgtattcagcattcttaggatccgccgaataaatgccccagaaaaatgaaattgcgatcaacacaccaccggcaaccaccagcggcagcatgtgcgaaaccccgttcattaaactggtgtaaatcttgttaccaattccggctgtactggtttcaacgttttcatccgcgctagccttggccgcaccgcctttaggcatataaaccggcgcgctgctcaacgcctctttaatcagtttatccggttcgcgaataccggctgcaaccggcacattaaccagcggcttgccggcaaaacgatccgcgtcaacgtcaatatcagaagcaatgacaacgccttttgccccatcaatttctccttgcgtcagtggatcatcgacaccggtttgaccgtgtgtttcgactttaatggtcaaacccattttcttagccgcttgctctaacgcctcttgtgccatataagtatgggcaatccccgtcgcacaaccggtcgcagcaattaaatcatactttgccatcagctaaccctccagtttcttaatcttaatttgcgtcaacaattcatccgtctcagtaaaatccgtaatccatgcgcgccgggccgtatcactgcccgccgcaatcgccaatttcagcgtgtccgctagatcctgcttttgataaagacccgctaaaaaggttcccagcatcgtgtcaccggcaccggccgtatttaacacgtcaatctttggcgcgtttccgaccagcgtcacatcctgattcataaacaaggctcccgccgcaccgagtgaaaccaacacattttgagccccagccgctaatgctttgtggcctaacttcaccatcgttgccaaatcggcttctccggattggttaaaccaactcatcaactccgcatcattcggcttcaccaataatggttgataggccaaggctttaacggcttccggatacgaactgtcgatgatcaacgcgaagccattttcctggctcagttttccaagttgcaacaaaaagctcggctcaatgccgcgtgcaaaactcccggaaacacaaagccaatcgtcagcacccagagtggtcagttgttggtataattgttttaatgtttcggcgctaatctccggcccgggattcactaatttatactcggcattgtcactgacaacgcgggtgaacacattaatccgcgtgaaaccggcatccttataaaaataattgcgaatgccttgctcagtcagaaaatccgcaatgtaatcaagggtaaagccgccgccaaccccaagcgcaacgttatcaaccccgcgccgcttcaagatgcagctcacattcacgcctttaccatttgcctgaatgtcataactatccgttcgattcaccgtattcggcgccatggtctgagttttaataaaaagatcaattgctggatttaacgtcaaggtataaatcacattaagcgctccttcatgtcgtttcttttacttatcaccatgttaaccgctttcaaccgaaaagagttttctgttttcagtcgttttccggattaagcgaaaatgcttttcatctgcatcaaccccactaaacaaggaggccaacctcatggctacactcagtcccacagaggcttatctttgggattacatcgagaatcaccaacaaaccgtcgtcaacttgtccatcacccagctaagcgtcgccgccaacgtctcaccggcaaccattgtgcgcacgatgaagaaaaaaggcttcaacggctacaccgaatttcggcatgatttgctaaaacgcattggcgacactgaaccattcggcatcctcgatcaggtggatgatcaaattaaaaaagtgattatgcaaaatcaaattgaggtttataacacccttgataatctgaaagtttctgtcatcgaggactcggttcaactgctcgccaaggccgagatcgtcctcatttttgcgcgcggcttatccgaatcaatcgcctcggaagtcactttgaagctccagttgctgggcaagtatgctgaattcttcagcgatcccaacatcatccaaaccatcgccggtcagatcagtccgcatgcagtggccatcacgatcaccttaaacggcgaaaccccggaactcgtcgccgctgccaaaacccttgccgcccgcgacattccgcaaatcatcctgacgaccaacgcccaagcttcaatcgtcaagtacgcggatgaactttttgtcggctataaatcaaaagccgcctattttgacaaatacgaggtggcctcacgtttgccgttgcaagttatgagccgcattttgctggatagttatgtggtgcgaaaacggggacagaaaaattaaatcttcggtatgtaaaaagcaatccctttggcctatatgacgagggattgcttttttctgcttattcgttattggcagtggatgttcgtggtaacggccggtgcttgaacatctgcgtggccgcaacagcctgttgccaaccggcgtataaattctcccgccgcgccggtgtcatacgaggttcaaaccgcttgccaatttggaaaatctgtttaagttcatccgtatcctgccaaaagccgactgccaatcctgctaaaaaggcagcacccatagcggtcgtctctaaattggcggctcgttccaacggcttattcaggatatccgcctgaaactgcatcaggtaatcattgcgggctgccccaccgtcaacgcgtaaggctggaacagcaatttgtgtgtccttgtacatggtatcaaccacatcacgcgtttgataagccaaagcctgcaacgtcgctttaataaagtcgtctttagtggttccgcgggtcaagccaaaaactgccccgcgtgcttcggcatcccaatacggtgcccctaagcctgtaaacgcaggcaccacataaacctcatcatcactagtggctgcctcggctgcttgctgggtgtcaggcgattgcgccaccaaccccatttgatcgcgcagccactgaatcgccgaacctgcgacaaacactgagccttccaaagcataattaatctgcccgttcacgccatatgcaatcgtcgtcaacaagttattagcagacattttcggcttatcgcctgtattcatcacaataaacgagccagtaccatatgtattcttcaccatccccggcgccaacgctaactggccaaacaaggcgctttgctggtcaccggccatccctgcaattggaaccgtgctgccgaagaaatgataagccgcgccggtaccgtaaatttccgaattactgcgcacctcaggcaacatggcccgcggaatatgcagcaactgcaaaatctcgtcatcccaatccaacgtatgaatgttgaacaacatcgttcgactggcattcgtgtagtccgtcacatgaatcgcgccgcctgataacttccagctcagccacgtatcaatcgtaccaaacagcagctcaccattttccgcgcgctcttgggctcccggaacatgatccaaaatccagcgaatcttcgtagcggaaaaataggcgtcaatcagcaagccggtcttctcatggatcattttgccatgaccagcctgccgcaacgcttccgccaacgcattggtctgccgtgactgccacacaatcgcatgataaatcggcagccccgtcgtcttatcccaaatcacggtcgtttcacgctgattcgtaatcccaagtcctgcaatttgccgcggctgcaccccagacgaaataaaggtgtccgcaatcgtcgacaacaccgcttcccaaatctcattcgcgtcgtgctccacccagcctggtttaggaaaatactgggtaaactccttttgcgcctcgcccaccatcttgccagcatgatccaaaataaccgcgcgcgtactggtcgtgccttcatcaatggccatgatgtaactatctgccatatgtacctcctgctttgtgtccgctttcacttcagtatacaggaattggtgaatgaggttaaggttcgtacagtttgaaaatcaaccgcttaagttcaatattaaaatcccgtccttttagcacttaccgtttgattgcttaatattaccgtcttcattggcaccatgctataataaaacacgaaagggagcatcggtggtgaccgatactcccctgacaagaccgttcaagacggttggcattaaatttgactaatcaaaaagaccgtcatcttagccaaaagattagcgacggtctttttgattgtcttgtattatcagcataatggtgatgatcagcgcaatcaacgataatacgaaatcaccgaagaccggcatcagcatcaacgcatcagcaacagacaactaggcacctccttccgtatagattttgatcatcgcgcataggcgaccacctcacaatacgttggatttgccaaccgtcattcactttcttgtcttgttcatgatgccatacaaaacggcaaaacgcctgctatctcaatgatttcaggcgttttttaattgtacatattttcttttaaccaccgtttttttaatgctaccttgccttccttgatgaacgctatccttctggttcagtgaagccataagtcgagtccgtctgcagaccccagaattcaggcagcttgtaactaatcgcatactctaacagcgcagggtcatcaaaaggtaaataagtcacccgatactgttgaataaaagtttgcgctttttgacgctggggaaaatactttttcacgatttccgcgtcaattgggccagcgagattacgttgtgtgtatggcaacttatatgggtcaatcccactgtcatcacgaattcgctgataaactgacacaaagtcatcgagatgatgcaaccgttctcggtttaaataagcgacattaatgttgttaatcgtgtattgcactggctgatcgccaatcattcgcaagcgtttgatgacgatgtacgcatcattggcaccaagtttcattctttggcgtactgtagcatcattaccagacgcaacgctcaaaaccttagtccactccggctgagtcttggccatattaagatccgtcaagtaaaccacgcggcgatgattttctttggccacaaaggtaccgcgcccttttatacgcgtcacccagtttttttcttggagcaaattaagcaccttaacagcagtggttgagctcacggcaaaacgatcctttatttctgcttcactgtaaaagcgatcgccttgattcaagcgcccttcactaagttctttgatcagttcatcgacaatctcctgatactttggcttggccatgccttgtctccttttcaaccaatcagatttgggtagtcgttacaggtccggcattttaaaaagtttgcgaacagatttggcaagcatccgtttgcttgcttattagtcagacttaactgtcctgttttcagacttgtaatcaatctgtgcaattctaacgacccagtcactgccataaggataccccgttgcgtcaactgtgagaactcttttatgcaaatcctgcgtaaaggatagatattcttcattatccagccaataaacagattcgattggacgatcaataccaacgaatgaacgcggattaaccccttcaccaccaagtacgacattatcattacctacgacttttagatcaaacacgcataagtaatcatgtgcgtctgcatgcaagacaaagtcacgcgcaccttgtccggagacgatcgcagttggtcgtccgcgatataaggcaggcgcggccatagtcgtccaccgtcctaataatgccatatacgtttttgccgaagccgggatcgcgccttgaccggtcaaaccaatattaaccaaaatattagcccctatatgccgggcatgagcaaccgtttcgataacctctgctggtgatttgtagttcaagtcgttggtcgcaatcccccagtgctgattcaacgtcattgagatctcgcctgcaacatacttcgcgttaggtgcaccgtggtaaatttcgtccggcgttcttcgttcataggtaacgacatcaatctcaggatcacttactttccctcgattcttcaatcccgtgttattgacgatgattgcatccggctggtatttgcgaatcatgccataaagcgcgggcagctgccaatctgcctcttttttattccaattaccgtcaaaccaaaaaccgccgactgggccataatgacggcaaagtacttcaaccgaagcttttaaataatccagataggcagggaaattttcctcatacaggggtgagtgccaatcgtatgttgcgacgtaaaaaaacggtaacagtccttctttgcggcaagctgcaacaaattctgctataagatcgcggttggcaggcgaatgcatgacatcaaaactgctcaaacctttagtgtcgtataagaaaaagccttcatggtgttttgttgttagcacgatatactttgcgcccatcatctttgcggcatgggcaatcgcttctgcatcaaattgatttgctgtaaaagttgctattagtttttcgtattcactgcgcgatcgatggtgaataaattccgtccattcaccaactgctagctgggaatatagtccccaatgaatgaacaagcctaatccaagatcctcataacgcttaattctcggtagtggttctgacattttttcacctcatttattttttgtgacataccctaacacgttaggttgatttttttggtgatttctgcttactatacctatgtcaatgtaaatcggttactttcccactaaatcaggcagtaatcaagtaagcccaaaatattgaagtcgtcattataatatgctaggctttgcgtgtaaagccatcttaacacattaagtatagacgaggtgatcaatatgtatgttctcgcaagtcatggtacttatgctgaagcgactttggcaagctgcgagcttattgctggtaaattagcaaactttacatcagtctcgttccacgatccgatgagtatagacgatcttttatctgcttacgaagccgcctatgcaaaagaatcaagcccggccaacttcaccattattactgatattccaaacggttcgccagccaatgccgctttagcatttaaacatcagcatcccgatattcaagttttttcgggactgtcactcgggctcgtcctagcactagcaactggaacgcctatctctgaagcggtaacgcaatcgaaagccattatcaaagaactttcgctcaaatccgagcgagaagatatttcgactgatacaactgccccctcaacaaataactcgcttcacactggtaacccgctaatcaatgttcgtgtcgatgcgcgccttattcacggacaagtcgcaaccatgtggaccagaacgcttaacgctacccgcatcatggttgtggatgagcagatcgttcaaagcgaagttcaaaagatgacacttaagactgctgttcctggtggcgttcatttgagcatcttaacgccatccggagctgctgagcggatactagcggaccagtatcaaggccagcgtgtcttcttaatcgtgcgtaatcccaaagcgctgcaagtgttggtaaaagctggcgttaaactcaaaagtgtcaacgttggcaacttatcaatggctgtcggtgccaaacaagttgctaagagtgttgcggtgacaccagaagatgtcgcagtatttgatgatttagccgcgcatggcgtgaagttgtatcaccaaatggttccaaatgatcaaaaagtcgattttatggcgttacttaaaaaaggagtgtgaaccttatggcaattgcatggtggcaaattctgttgctaacgttgcttgctttttggatgatcattgaccaaataacagtcgggatcctaactaattatccgctgctctatggtttcgttgccggcatcatcatgggagatgtgaaaactgggctggttgtgggggcaaccttgcaattaatggttcttggcgttggtacatatggtggtgccagtatgccagactttatgactggtgctattatcggtaccgcttatgccgtcatttctggaaaaggtattaactttgcaatcgggctggctgttccagtgggtttactcatggtgcagctagacgttcttgcccgttttaccaatacgttcttcttacaccgcgttgaccgttacatcgaaaaaggcgataccaaacacgttgcacgaaatattgtttatggagtcttcccttgggggctatctcgtgccatccccgttttcatcatgctacttgtcggcaatagtgtcgttcaaaaggtcgtcaatgcgatgccagcatggctttctaaaggactaactgctgcgggcggcattctcccggttgtcggcattgcgattctcttacgattcttaccaaccaaacgcttcctctcatatctcatcatcggatttcttgcagcggcctatcttaagattccgatgcttggagtcgccctgttaggactagcactggcaatcatttactacaaacaaagcaaccattcttccaacaatgaccacgatcattcagaagcacacaaaggaggttttgaaaatgccatcggcgaatacgaagactgaacttcccgaaaaacttaccaagcacgacctctttcgggcaaactggcgctggctatggagcagccagatttgttggaattatgaacgcatgatgtcaactggttatctctacaccatgttgccaaccctgaaaaagttatacaaaaatgatcaagacctcatcgaaatgatgaagatgcataatcaatttttcaatactaacgcctacgttggcggcttcattgtcgggatggatatggcaattgaggaaaaaaaggggcgcaaagccgaagacactgtagccggcctcaaaacaggacttatgggcccatttgcaggcgtcggcgatacgattgtcggtgtcattttgccaacaatctttggatccattggtgcttacatgggcctcaaaggcaatccaaccggtgcaattttatggctgttagtcaactttgcaattttgatattgcgattctttttactgccgctcggctactcacaaggcgaaaagctcatttatgctgcaggagacaagcttaatcgtatcaccgacgctgcaattttactcggcgtaaccgttgtaggtgctctaatccctacagttgtatccgcaaacgtccccctcgttttcaaaaccggaaaagtcgttttaaaagcccaaacagttttaaatcaaatcatgccttccctagttccggtcgctttagttgctttatgttattggttacttggaaagaaaaaaatgaactcaacacgactcatcgttttagtcttgatcctcggtatcgttcttggtgcattcggtatcatcggtaagtagtcacatattttaactattgtttggaaacccgcatggctagccatgcgggttttactgttccttggagagagaaagccgaaaaacagtattctcgtttttaacttcttccatacatcaactcattcatttcgaccagcctcaagttacatatattgactatttacaagtcagcagtcattaacgaccacagctattaaaaatatgtcattgccttcttcttattccattcaggcataacagcattcaaaactcgaattgaaaaggtttccaagccagactagcctatattttgaaatcaattcggctggttcgctgttccggcctttaggagtgattaatatgacagcatcaccttgggacttaagaaaagtattggatgaactaaaacaggatccgcagcaatatcatgaaacagatgtgcaagtcgatcccgatgcagagcttgctggcgtttatcgttacatcggtgccggtgggacggtcgaacgtccgacacaggaaggtccggcaatgatgtttaacaacgttgtcggcttcccaacgacaagggttttgatcggtttaatggctagtcgcaagcgggttggcaagatgtttcaccaagactatcacacgcttggtcgattcttgaacaaagcggttttaaatcctgttcaacccgttacagtcgaagaatcggcagcgcctgcgcatgaagtcgttgccaaggcgagtgacccggactttgatattagaaaactcgttgcagcaccaaccaatacgccacaagatgccggcccatacatcacttgcggcgtagttttgggttccaatatggccaaaacaatgactgatgtgacgattcatcgcatggttttggaagataaggatacgcttggtatttatatcatgcccggtggtcgccacattggtcattttgctgaagaatatgaaaaagccaataagccgatgccggtgaccatcaacatcggcttggatccggccattaccattggtgccacttttgaaccgcctaccacgccgcttggctacgatgaactaggggttgccggagccattcgccaagaacccgtgcaactggttcaggctgtgaccgtcgatgaaaaggccattgcgcgttcagaatttacactggaaggctatatcatgcctaacacgcgtatccaagaagatatcaatacccataccggcaaagccatgccagagtttcccggctatgacggtgatgccaatccggctttgcaggtaattaaagtcacggctgtaacccatcggcgcgaccatcccattatgcaaagtgtcatcgggcctagtgaagaacatgtctccatggccggtattccaaccgaagccagcattttgcaacttgttgatcgtgccatccccggcaaggtcaaaaatgtgtacaatcccccagctggtggcggcaaactcatgaccatcatgcaaattcacaaagataatccagctgatgaagggattcaacgtcaagctgcattactcgccttttcggcattcaaagaattaaaaactgtttggctggtcgatgatgatgtcgatatttttgacatgaatgatgtcgtctggacaatgaacacgcgttttcaaggtgatcaggacatcatggtattacctggcatgcgcaaccatccgcttgatccgtcagaacgaccgcaatatgatcccaagtctattcgggtacgcggaatgagttcgaagacggtcattgatggtaccgtaccatttgatatgcgcgatcaattcaaacgagcagcctttaaaaaagtttccgactggcaaaaatatttgaaataggtgattgaattgaaacgtattatcgtagggattaccggggcatccggaactatttacgctgttaacctgctccagcatttacatcgcctgcctgatgtcgaagttcatttggtgatgagtgcttgggcaaagcaaaacctatcacttgagaccgacatgaaacaaagcgaactcgaagctttggcggattatgtttatcctgttcaaaaccaaggggcaaccattgcaagcggcagttttttaaccgatgcaatggtcattgtcccagcaagtatgaaaaccattgcgggcattgcgatgggctttgatgataatctcattggacgagcagccgatgtcacgattaaagaacagcggcaattgattattgtgccgcgggaaacaccgcttagtccaattcatctggataacctcgctaaactagcccacattggcgttcaaatcattccgcctattccggctttctatcagcatccccaaaccatccaggatttaattgagcatcacaccatgaaactattagacgccttgcatattaaaaccgaaaccgctagtcgctggaatggagcgtcgttaagatgaaaaaagttctcaataaacagagtatcggttttctcatcggcattgcggtgggcctcattgtttacctggccccactgagcggcatcaatgaaaaagcgcaaatggatcttgctttgagtttaatgaccgttgtttggtgggcattccagattgcacagccggcttatattggcggtatttatctgatgctgctgatcttgacgaatgttgcaaccccgacacaggtatttgcgggatcgtggaccaagtcaattatgtggttagtgatgggcgcttatttaattgccggtgctgtccgcgaatctggcctaggtgaacgtattgcctatgctttcattatcaaatttgttcgcagttggaccggtattatcgtctcaatctttgccttaaccttcatacttgctttactgattccgcatccctggccacgtgccttcttgatcatgtccgtgatggatgtggtcgcaaccagcgccaaaatgccacaacaggatcgggctaaacttggactagccgtttttgccgcttcctgtcctctttccggtgcttttctaaccggggatacatcgctcaaccccttagcaattgctgattctggcaaaagcgtcaactttgtccaatattttatttacatgggggttccgatgatcattgccgcgatcaacacgatgctgctctttcttttcctcttcaaaccaaccaaaaaagtcacgattgaccttaatgttctgaaagccaagcaggccgatcaaggggcaatgacgcataaagaaattcgagtgatcgtctggcttgtcattgccatcggtttatggttaaccagtggcatcactggcattgacgttggctggttaactttgattgtcgccttgctgatgagtctgccggttatcggtgaggtcttgacggcgaaatcatggtcaggtgttcccgtcaacgttttggtcttcctgacttcggcaattgcaattggccaagtgggtgattttacgggcatgaataaatggattgcccaaacgattctgccatcagccttaccacataatctctacttactggcactggtcattaccgtttttgcaatgatcattcacatgttcatgggttcggttattgccgtcatgggtattacaatccctgccattatcgcggcaacctcgtcacttggggttaatccgttggcaatttcattaatcgtcttttcagtggttaatttgcactacatcttatcgtttcataacctggctattcttgtcggttccgattcagaaactggcggtggttatacgcaaaaagatgtcatgaagttaggtattccgctaactgccgtcatgtttattgttgcgctggtagaagtcttttggttccagctgactggacttttataacagcgatacccttgttaaaagtcaatatcaatgcaaagtagctcctaaatgatttttctttaggggctactgctgtatcgttaaaatcctgacggctacacaacattcgaaatatcgtcttgggattttgcaatcgcggtaaccattaacctttttcggcgataacttgctggctcaagtagtcagcaaatttaagaattgccggattgctagtgcggcgataaaccagttgcaaatgactacaaatattcggcgtcaatgacttagcaacaaagttcgaattggcaaacggctggtaagattgacggaacaaaaaggtaacgtggcggctgccttcgaccatccccaaaagtgtctcgatatgcggactgctaaagatgattttgggtgcgatatgacgatccgcaaaaaacgcctgcattggctcaaagacaccagagccgcttagcaagctgacaatcgttatggcggctaaatcgtttgcagacaatgatggacgttttgctaatggattggtcttagcgagaataacttgcaactcatctttagccagatcaagtttgacatattcccgcgtcgataagacctctgcttgtgtatcacgtagcaatgccatatctaaatcaccggtcaaaagctgcttgaggatgctaatgccttcctgttcgaccacatgaagtgccagcttcggaaattgagcggcaaaatcgtttattaatcgactgatgccaaactgaccaagaattggaacggcaccgatcgttaaaacaccgttgctcaaggacttcaaactatttaaatccgtgttcatgagctcgacttggtgcaagatcttactggcgtgaaagaaaaaccgttcaccagcctccgtgacaagcatgcggcgatgattgctagtatccaccaacttacttcccagaatagcctcaatatgctgaatacgcttagacaaggctgattgactaagatgtaaaaccaccgctgctttggaaaaactcttaagctcatacagtgctacaaatatttttaaatcctcaaaattcaacttattcaccaccgaaaggaagctataaaatgtccgactaccctgtcccgacttatacgacaaccgtgacacaatctgacgtcactctcatcgccaccgttactgtgatcggacgtgacctactcattaccattactggcggcgaccacccgcatattggcgatgttctcacgttaaccaaagatcaacccattcaaacaatccgctaccccagtcatgataacagatttcataaagatgatttacttgcgcttccaagtgccaaagcgctgcaaccattactgcccggaagctgcaccattttagcaggattgcacatcgatcacatcagcaaagtacaaatccaggctgcattagatctcagccataaactagcgcctaagttaacaacttggctaaaacatcaaacatttgcaacgtcaagaccacactattacggtcccgatgaatcacctgcttaatcgctcaaccagatccgggaattcgttaatggacgctaattgttgacttcaaagatgttccctcaatgatctgctaatttagccgccatcgttgtttgcagtttctcaagcgcattgacgactacttccgcatcttctcccaaagcgttgcgcaaaaaagcatcattttggtcaaagaaatgccgaatatatgccgctactttttgagatttttccgttagctgaatcgctttataccgcccatcttgcttggagggcacacgaacaatcagttccttacgctccatcaattgcaaaagtgccgttgctgaagatttctggatgttgaattcatgttcaacatccgtctgatacaacggccgtttggttccttgccgtgccaaaaaatcgatgatgctcatttgcacctgtgttagacccaattgcttagcttcacgatcagcataacgttgcaggtcattgtttaattttttaaccaaaatacccagcgatactgtcacgatgtctatcccctttcagttccaatgagatctcaggtcagcgtttacattaaaattaagccttgatttcagaaaataagaccgctatagtagctatagttcgatatagaactatacacgatggaggtctttatgacaagaaaagtaacacctaaattatacctttcgattcttgccactggtctgatggcgttttgcggggtactcattgaaactgccatgaatgtcacttttccgaccttaatgcggcagtttaatgtcgatacgggaaccattcaatggctgacaaccggctatttgttgatcgttgcaatcatcgtcccgatttccgggttcttaaaacgacgcttcacgactaaacagctttttcttaccgccagtgccttcttcatccttggcttagcactgtgcagcgttgcaaacagttttgcaatcttgctcgtgggacggctaatccaaggctgcggaacagggattgcactccccttaatgtttaacattattttggaacaggcgccgttagaaaaaattggttttctcatgggcatcgggacgttggtaacagccattgcgccggctttaggcccgacttatggtggcgtgctggttgacattaactggcatttgatctttattttcctgctattcgttatgattgccgctttgattatgggactcttttccatccagcaagtctctgaaacggttcatcttcatctcgactttttggcttggttattcattgcgattttctttgcgaccgcgattcttggtcttaatagcatcgagcaccaacccggacgcgccttgatctttgccgtcattgcaattttaagcctcggcgcctacaccatgcgctcactgcatgttaaagaaccactaattaatttacggttatttaaaaatcttccgtttgatctgcacatgacgaccttcctcatcattcaaatcgtcaatgtcgggtttgcctttgtcttacccaactacttgcaactcgttaaccacacaagttccctaactgccggcctgctcctattacctggggcggcactgggcgcatgcatggcacccatgagtgggaaactgtacgataaatcaggtcctggacgccctatctttatcggactatgcttacagctcatcggaattgtctggctactccttgaagccttaaccgcagccccggtcatcgtcttgatcggctatgccttcatcatgctaggtaccggtttttcaatgggcaacattatgacaagcggacaagctcagttacaccaagaacaaaccactgacggcaatgccatcttcaacaccctacaacaattcgccggtgcacttggtactgcagtcgtctcactcatcatggcgctggcccaagccggttcaacctctgctcacaacactgccatcggttcgcaacatgcgtttggtttcttgctgctattaaccctcgttggtgatgtcgcgattttctttgggttgcggcgacgtcgtggtgaaaccgaaaatgcgtagaatcactattaaatactagaccgaatgtaaaaaggatcgcactaagcagcagtgcgatcctttttcaatacgttcaagtttaattttgatgatccgtacgtgtccctactgttctcttctgccatggcagccgattacgctggcgtcgattgcgaatggccgccagtagttgagcttgacgatcacgttcatttcgagcatcattttgctccagtttagcaaaagctgcgcctgtcaatagcatcacatttgtcggtaaccgccgcgtcaaaaaggcacggatatctgactcaggttgatcaaatatcaatgaatagcttccacctttttgagaccaaaatgtcaccatcgtaccttgtttaatcgtttcggtaatcactcgatcatagcgactataatcgctagcgtgcgcaaccgatccataggtaataaccttggttttgcctaagccttgacgataaaggccaacgcttgcaactaagagcgccaccatcaccagacgtagattgccaatggtgcttgtcgtccaaaacaaggtgacgatcaagctggccgcggcaagtgctacgccgatcttaatctttgatgacttggttttgatttggagttgccgctgctgcagaaattccaggtaaagtaagccaccaagcaacatcgcggtcgtcatcacatctaccatttcaaacgcctcctcagattggcgtcaaaccaagcacgactaccactctgcaatagtgccatcataattcttccaggatggattgctccaaaccaaaccttcttgggccacctctttaattttgtcttcatccatatcaatgccgagtcccggtccttttggtagttgaacataactatctttgtactggaagatttccttattcttcacaaagtccagtaagtcaaagcctcgattgtagtgaatacctaggctctgctcttgaataaagacgtttggcgtgcatgcatctacttgcaaagttgccgccaatgacaccggtccataaggtgcatgcggtgcgactgccatgtcaaacgcttcagccatcgcggcaattttacgtgtttctaaaatgccgccgcacaaggcaacatcaggttggacaatgtcaattgcgccttgacggaatagatttttgaagtcccaccgggtgtataaacgttcgcctgttgcgagcggaattgaaacttcacgcgcaatatcatcaaatgaatcccagttttccggcaaaacgacttcttcaagaaacattgggtggtatggctctagagcatgtgccagtacttttgccattgggcgatgaactcggccgtgaaaatcaatcccaatttccagttgatcgccaacttgatcgcgaattgaggcaaccctatcaactactgcttgcaccttattatacgagtcaatatagtgcagttcagaagtcgcgttcattttaatagctgtaaaacccttgtctactcgcgcttgtgcctgttctgctacatcagatggacgatcgccaccaatccacgagtaaactcgaatccgatcgcgtgccgctccaccgagcagttcgtagaccggtagattcaacgctttccctttaatgtcccacagtgccatctctaggccagaaataatcgtgccattaatcggaccgccacggaaaaatgaacgatgcatctcttgccacaagcgttcaatttcaaatggatcacgaccaattagcttcttgcccatctcataagcacccgcgacaactgtttcggttttggtgccagaaatcatttcaccccagccagtaatgccttcatctgtcagcactttaacaaagatccaacgtggctttactttataaactttgatatctgaaatcttcaatgtgaaaattctcccttcaagatcatctcaactaacaatggtgacattaagcttgggcacttttttcattctgagcatccatggcagcattcacatgtttgataccatcgaagaagtaccacacgccagcaaaaagaaccaaaagtaccggaattgagatcagcggatgccaagtaaatgcgaagtaaaccgcaaaactttggatcatcgaagttgccgcaaatgatgaaatgtacaacgagttagcacccagtttgatcccaacagacttagcaatttcggttaataccggtgccgttgatgtcccgcaccagagaagtgaagctgttactaccaaaccaatgatgatgttcttaagcaagttgccattcgtcaaagctactaccaacgctactcgaaatggtacaaccgctaaatcggcaaatggcagaacttggttgcccggcaatactaatgccatgacgatggtcaatggaataataattaacgctgtggtaataacatcagcattcccaacgacaaccgcggcatccaatccgatgaacaactttcggcctttaaaccgcttttcagaccatttttgtgcagaatccgaaattggcatcaagccttccataaacagcgatgtcatcttcggaattaagaccaaaaccgccgccattgaaacacctaattgcataatcttcatcaagtcatatccggcaaaaaagccaatggccatcccgattaacaaacccataatcattgaatcgccaaagaatcccagatacttctgcgcatcacgaattgaaaacttgttccggcgcatgaatggaatccgatcgagcaaccaatttagcggccaggcaatgactaatgatgacaaagctgacaccgttggtaatgaaacccctggcatgccgaaaaacttctccgtcattggctgcgaccaatcagcaagtttaaatgtcaccaatgccatcataattgaagatccaacaccaagcgcgatgttcttggtgacaaagtaaaccatgacgccgacaattgccatgtgatgataattccaaatatcaacatcaagcgtatgtgtccgcttgataatcagcagcacaatattgactgccaaaatggcaaaaatcaaaatagcgataatcggtgatgcccaggtcaccgcagcaattgagccccatccgacatccagtgctgtcagatgtgcaccagtacgctcaaccatggcttttgcggcaggcccaacgttggtcgtcatgaagtccaagattaacttgatcccggcaaaaccaatgccaagggttaagccggacttgaaggctttatcaatgcgcaagccaaaaatcattccgataatggtgataataactggcaacagcaccgtgggaccggcagcaatcagccaattaaagacattcattacgatattcatagatggttatccctccaattcggtcaaacaaactcgaccttgttgacgcatctgctcacttatccttaacagcctcataaattttatcgagcgcgtcctgcgcccccacaccagtcagcagaggcagtccatgaatataagggacgccatgcgtttgtccttcaaactgaccagtcgtcaccaataagtcatagttctcaaccttaccaggaacttccattagcttagtctgagtggtttcaacctccactcccttttccgccaagaacgttttgatcttagacgcaaccaccgttgaggtcgcaataccattaccacatgcaactaaaatatgagcagccataattcttttcctcctaatttttatatgagcgcgagccaacgagtgtatacatggcgtgagaccttgctcgcagctttccatgtcatataacgccttatttttttacttaaaagtcttcattaataactgatataaagcatcagcatcagttgcctctgcaatcgcatgccgcaactggtcatcctgaatgacatccacaattttttgtaacatctcaacttgcccatgcggctcgccgatagccatcatgataatgacatccacatcgagtacattcttgacatcacccatatcatgaaacttaacaggatgtgccaaggtggccaccgaaatggttgttttcttaactagttgataattcgcgtgtggaattgctacagtcggtctcggtgaaggtaagccggttggatacgcggcttcacgatcgagaattgcctgtttgtaaccttccttaacgtaaccttgagcgagcaaattatcggctatttggctcagagcatcgagattgtctgtcgcctctaaatggggcagcaataattttttatcaagcactaaatcaacagccacaaatcaatgcccctttctacagtgaatttttaacatcgacaaaggcttgtaacgatgctgccaagccggcaacatttcggttggcaagatcttcagcgttaaacatctttgatccgataccaagatagctcgtcccatgggtcaaaaggtctttcgcattgtcgatcgaaacccctccaactgccatcagtggtaattttccaagtggtgcctgaatagctttaaagaatcctgacccgactgtcgttgccggaaagactttgacaatatctgcacctttttcaaacatcgtatgaacttcagtcggtgtcatagcagccggcacggtgatgactccatgctgtttggcataggcaaaaatgtcgtccgtaaactcaattggacttagcataaatttcgcacctttagctatagcgtcttgagcctcggtcagcgttgtcaccgtcccggcgccgatcttgattcggtccccgtactgcgcattaccttcttcgataatgtccagtgcatgcggcgtattcatcgtcacttcaacaccaaattgattttcaaacccagccatcgcctgcataatggcatcagcctgttcaggcgtataaccgcgcataataactgtaaaagtcggatactctgataactccataatcttcctcctgagcgtgagccggtgcattagtcttgataaccaaactcacattattttccttgcttctcaaagcttatgaactcgtgcgtaaccttgcttcatacgcttgcaacacttcatacgcttgctgattcgtttttgattttagtaattgctttagtgccggctcgtcagcaatgagctccgataactcctgaatcgctcgcaagtgctgatccgtattcttaaccgcaatcggtacgatcatgcgaatgcgaaaaccgttcggatacgtcaccggatgcttcagaatgtaaaaagcaaagccgttacgaagaactccgttttccggaacagtatggggaatggcaacctcggtaccaataaagctataattatccggtgccaccgtttcgttcatgagcgtttgccgaaacggctcggtaacgtatttcaattgttccaatgggcggatcgcttgacgcaatgctgtctcccaatcatcgctttgaccaatttgaatcaaactcgatgcagtcatggctgacagttggggttgctgcgtttctggaagtgtctcaacaccttgatcagccagaaaccgccgcaatgcttgatccaatccttcagaatccgtaatcttggcatgtttgcgtacaatcgcagttaacgccgctattccggtttgaatattctttacgccaatatcatttaagacgcgatatcgcagctgcatttgctcatcctcgcttaacagcggatgaataatgtattgacgcgccgaagtcttcaagggaacggttgtgaaaaccaagtcgtaatcgcctgaaaaatgttcaaattcacgagcggatgtggcagacaaaaagctgatttccggaaatagccgacgcaggttctgaatcatcagctttgaaacaatcaggccattcgtacaaacaaccgcagcgcgttctttattggcatgcaaatcagctgacttttccaactcaccatcaaagtaaaaggcgatcaggtttcgctcatcttccggaatcggcttaccggttagcttctcgagtggtgcaacaatggcattgatcgtgtcgaccaaaaattgatgtcgaggatcagccgccatcacttgaccaatcccaatgtcgtgcagatgcaaaccatagcgaacgcggaagattgccggacgcaaatgagcaagtaaccggtttacgaaatctttctggtcatcaattttaataaacgtctgctgttcaaacttggaaaccattgttcggatggccgcaaccaagtcagtatctgctacaccaacttcgccacgaatcgtgttcgcagataatagcaacatcacaatccattcagcatcggaatcacagactaaccactttttaggtatcagcggcttaagcaatgaaaattccttggtgtcattgatctgatgcacaaaatagtggttgtctcttgtccgctgtgatagattacgcgtgacattcatcaacaccgccaacatcaagaagctaaacgattcatccgaataggtgacatgccgaacactttcaattttgtgaataaagtggatcacttgctcaggtggcactgtacttagttgttcgattgaaccacgaccatcatcatatttcagcaactgagttactagataattcagcaaattacggatgatctgctcggatccagcaatgaaatagccagcctgtcgcgtatacttaagcgccaattgccgccgctccagaaaatgtgcaactattttcagatcagcggaagtggtggttcgactaactccactgaaatcatataaatgcaccagtgacaactgttcatcactcacgagtaaatacaggcaaatgagtagcactcgttcatcttcttcgcggtaaacatatggcgccgctgtttcaccgttttgcagattgaaaaattcggcgacttcgcttggtgtcacaaattcacctcgaggagtacgggtaattttaggcaattgacggtcaaccagctcctgattgatctgtgccaaagcataggttagttgccgacgtgtaattttaaactgtttctccaaatcaccacttctcaaattaggatgccgaataatttctgaaaggatttgcaagttgcgtttcttcactcaaccctcacctccaggttcaatatcaattgtacgtgtcaatccgcgacttgtggaggcgctttcatgacggcttttgtacaccccgttagtaatttacatgtacaaggtgaacgcttcatgccacaaagaccgcgctcatcagttttaaattttggaaaaatgcaaaaaaaatacccacaaacagaatgtctgtgagcattttcaaatctgattgacccaattattcgcttttggtggcaattcgtttgtacagatcaaccacttcacctgctagatctcgaaacgtaatggccgtcatgacgtgatcctgaccatgcaccatcaataaagacacggattgatggtgtccatttgcctcatcagtcagcatgctggtctgagcattatgcgcttccgctaaaaattgatctgcttctttaagcttgaccgcagcctgttcaaaatcagcagcttttgccgccctaattgcctcaatagcagaactttttgcgttaccacccgccataatgagttgcataacaacaagttgttgcgcttcatccatgacactttcacctcccaattgactcagctgtcttaaaactttcccgtcatgacggcattaaatctaacgctgtttgtaatacgcgatcacctttcataagcccgtaatcttgcatatcaatgaccgcaacaggaatcgtcaaagactttttaaaatcgccttctaaatagcgaacttgtggccctaacaataaaacatcgggatgatcagctgccaagcgatcttgagcatctgctgccgatgcggcaaatatcgctacgttaatgcctgctttttccgctgcatctgccattttcttgaccaacatgcttgtagacatccccgccgcgcaaactagcatgatcgttttatctttttttgccatgattaaagtcctttcttctatctacctttgttgcccgactgcattgcaagctcgggcacgtgcccggttgacgaaactttttgaaaccagtaacccgattttttaagtgatttggtttgggtgcgcaaatcattgcggatcagaccgtaacgatttttatatgcatttagccacgaccaacaatcaatgccggtccacgaaaagtaaccgtgacaattagcgccttttgcaattgcccgattcaagaattgaaggtgctcagtcataaatcgaatacggtagtcgtcttgtatgacgccatctttcaagaaacgagtttcatctgccacaccaatgccgttttccgccacaaaccaaggtatattgtcatagcgatcttttatattcatcgcaatatcgtacagtgcagcaggataaatctcccaccccttatccaagttcatctttctacctggcaattcgtaatgatcaaaataaatatcaggcaaccatggctgcaggctctcaggatcaattgctggcgcttgaacgcgaaaaggatggtaataattgacgccaagtacatcaatgcggttagccgaaatgatatctagttcatctggtgttgcatcccataaaacaccatcccgctcaagtcggtcaacaagttcttcaggaaaataaccatgaatcgctggctccatataaagatcattggcccacaactcggcaaagtgggcagctgcccgatcattatctgcttgtgacgcaggataaacaggcgtcaaattaataatggtgccaatggtgcccttaggattacgattaagctttctaaatacagcaatggccttagcactagctaggttcagattataggccacctgtactgccgcctttccatcaacaatatttggatagtgaaattgatataaatattggccatcaacgattactttaggctcattgaatgtaaaccagtgcgtgacttgatcactaaagagttcaaaacagcgtgcagcaaattttgcataaagttcaacaacatgtttggattgccaaccgccatattggtgctgtagcacaaccggtaaatcgaaatgatgtaaattaacatacggtgtgatgccaagatcatgcatttctgcaaacacacgccgatagtaatccgcacctgcctgatccacagtcgcctcttccaagtcgtcaatcaatcttgtccactgaatagaaatccgtaatgcctgaacaccagcacgttttaacagtttcaggtcagcaatataatcgttataaaaattcgatgctacatccggtccaacattatgatgaaaatcctgagggcgggtatggtaatgatagtcaaaaatgttttcatgttttttatgaaaagttccttctgcctgcggaccacttgtagctgctccccagacaaaatcagcattaaattggatgataactccccttctttctccgcgtctctgcttaatcaccatttctcaggctaaattgctcgaagttaatggctgctccgtataaattggcatctgcctgaaagctagcaattcgaatttgcggtcgtaatggtgcaatcccaacgtgagccatgacagaatcaagtgcttgctctaaatctgtcagtaaagctgggttttgtgacacgccgccaccaatgatgaagcactccggatcaagactatattgcaaattaaaaatcgtggttgcgacaacatccaacatatcttgaattgctttttttgcagagacgttgccgtgttgtgctaattcatataaccctttaccatctaactttgtcccatttatacggttgtatcgtgccacagcgtttaccactgtaccaagatgactaacagtgtcagcttcaccgtgtaacatgtatccaagttcgccacccaaaagatgttgaccatgccgaacttggcgattcaatacaacagcgccgccaacgcccgtaccgagcactataaaaacagcatctcgcacatcccgggctgcaccagcatgtacttccgcaagtgctgcacaattagcatcattttcaatggcaaccggtaattcaaaacgattatttagttctgctacaatcgggaaattatgaatgtacggaactgcgctggctccgcgaataatcccagtaatttgatcaaccataccgggactgctaatggcaacgccagtaatatcacctactgcacgcaattgtacgatcttcttttgcagcagcttgtaaaattctggcaatgtcttcggagtcgatgcatttgttcgaaatgaaacgcctgttaccgaatcgtattgtccaaacttaatgctcgttccgccaatatcaatcactgctaggctcatggtttcacttcccttttctgccactgaataacatcaagcgccagctgacaaaaagtcatgtttgcccacgaaaaccaagttcgcgtatattgccttgaatcatcttgatgcacaccttcatgacactgcccagtatccccagtagttgcagctattaatgctagtttgtcttgtttgattgaatctgctgttgctactaatccttccatggctacggcgatcggccaaacataccgcggtggtgtatgttcgctgccaattccttgtaacacgctgcctttatagaaatatggattttgcatactagttacaaacgactttgttgctatataaagcggatcttcagcactcaacgcccccaaaaaaggcaggctcaataaactcggcacgttggcatcatccatgaaacaagcgtggccaaggccatcaacctcgtaagcaaatccccgttcaccactaggcaacgtttgaataccatattcagtaattccttggcttatagctgccaccagcgtctttacgcgaatcgctagtgcttgtcgattctctggaatataaggtaataatgaagttaaaactgttttggccaataagttagccggaatgtgatagccatgttcacatcgattatcacttggtcgaaaaccatcccaaattaaccccgtcaccgctacgggactgccataaccttgatgaggcaatgtgtcgttactagctgtattgggacggcggaaaaagtatggtgaatgttcatgatgctgttcctgctcaaaaacatcgacaattaccgctaaagttgtccaaaaatcggtatcaaaaattgtcgcatcaccagtctccgcaaacagacgtaacgctagtagtaaaggagcacaaagggtatcaatctcaaacttacgctcccaaacttgcggcgaaacttgtatattggtttcatccgcatcacaccagtgggcgccactgatcgtttcattaaaggcatttgcgtatggatccagttgaataaagtctagttcgcggcgaagcacaccttttaaaatgacttccagatcggggatagctttgacaagctgaacataaggtaatacctgaaaagtcgcatcccgcaaccacatcgccggaatatcgcccgttgcaacaaaataagtgccatcgggttggagacttgtcgcttttattaatgcgtctggcaacagcgcccggaacattctttgtgcattcaaatctgctaatggatgagcatcaacaaaatcagttaatgctgttgccaactttactttttctatcgtcatgatcatcctttcgaagctgcaacgtcattattaagcgggtaaataccgtatgtacgtatttctccagccttgaatggcgtaagttgatagtgtgagacactggttgcgacagtttccttggtttcgtgattaagggttagtagccgaacactggctagccaagcaaactcaaatactccggggtcttcacacgaatctgatgtgggattataaacccgcacgagataaccagcctggtctgaagttgcagttacactggatataactaggtcacgcgtgttcagccgaagtgacggctggtgttctaaagcagtctgattagcatttatcgggaaatattgtagcggtgttgtaaagcgattaagtgtctgcttttgatagcttaaatctcctatcgctaaagcctgcacgcgttgttgtatctcagccggattgaactgttcatcaaggcaaataccgccctccagttgttgccttcccaacaactggctatcaggtgttggcacgtaccgcgtctgtaaacctgaggcatcacccggacggcgtttcaaatccggacggccaagataaccgacacctcgaaacatcgtgacagctagttgttcaaaatgttgcccaataagctggcattctttctcaccaagaccaagaaatgtccagctagtgattggatcgtgggtatttgcaaaatgaatcattggccgcaaaccagtgggttcttcatgataaccgattgcttgccagtcattcaggtgtggatcaacgaccggacgtttagcaactccaaacggcgtgtcggcaaaactatactgtgcatgtactggcgtcgttaaaatcagtcgtaggcgatgatcaaggatattattatcaaccgttagtttaaaatgaataaccggatcatttgctaacaatttcaattcaagcgtataaggtaggatgacatttgctttttttgcggcgcggtctgaaaggtcttttggtaggtgccagcctcctttgaaactcaattcactgactaactttccctgatggcctgtcacttcagcctcttcaagtgttaagttgatgagccaatcttgatatgctggcgagtaatcatacgtgtcgccttcatcgccaccatcatcaaaatgaatcgggttgacgaaagactgccctgttcgattgtccgtcaatttgagctcaccgttcgtaaaactcagtgtgtagtactcattgcgaatggttgtactgtctgaccttaatggaaccgcttgttgtgcagattctaatgtaaatccaacccagtccattgctttcatcactaatggcactgcaatagttgtctggtagtaaatcatcggcttttcttgtgttttgtcacgacgcaaaaccgcatcatcaacttgaacttgccgcaatacttcataagtaaccggcagaccgtgctcatctttaagagcaaagtacttatcacgggtggcaactgttatctgacctgtccgagtaactgattgtatggttggattccaaaagaaaacattgagtgacggcgctgaactacttgctaatttgcgtaagagataatcgcgtaaggacgttgccagttgtaacgcattgttaccacgctggtaaatatcacgatttgtcacatcggaattacatccgccggaactatcatgcgcttggccacgagcaattgttttccaaacctgttctaccagcccgctttgtgccttaataccttgatgtgcagcaatgaccatcagcggctcaaccacatctaccataagatgttcaagccgatcataaagccgttttaaatctgctcgcgatgagtagatacctcggtgaattttagaagctgagggatcgataaactccccttgatacgtagtgaatggtgaaaaactctaaaagtgttttcataataggctttaccaatagttaagcgtataataagtgcaagcctcatttgcccgaaatgcctatgctttgggatttacccttgcacttatcgctgacctatcggaggaattgatcatggtttatcgtcaaaaagcaacgcaactgtcacttgaatcctttggaagcgctctgggaacaccgctcagcccggacaacgagtgggttcaatatgcagaattgatcccatgggccaaacttgaagaggcataccaattacagttcccttcaaaaaccggccgagcagcgaagccatttcgattgctttatggcgcaacgttgatcaagttgaagaaaggcctgaccgaccgccaagttgtcgacgatatccgtgatacaccagcctatcagtacttcatcggattacccgaatatcgcgctaagaagccatttgaacacacaacgttggtgcactttcgccaacggctttcagccatctcagatttgatccgcaacattactaatgacttcacgcgcgagcggttggaggccgatctacctgaggggacgcatgttttgattagtgatgcgactgccgttccggtcaagatcaagtatccccaagatacaacgctgcttaaccagagtcgtttgaatctcgaacaaatggtcacagatctggcccacgggttaggtgtggaaattccgcggacatacagacgtgaagcaaaaggtaagtggaccgctttttcgaggaaaccgcggcgtcaaaacaaggaacgccgcaaacagcttcaagctcagctacaatacatccgaagagatctgcgatatgtggcggaactgcttgcgcaaggcggtcagctcactgattggcaagcacagcgtctggaagtgattaaacaagtctatgagcagcagctcttcatgtttgagaaccacactcaccatgtcgagaatcgcatcgttagccttcaacagccgtatatccggccaatcgtgcgaggtaaggcaaagcagtccgttgagtttggcgccaagattgactgttccatgttggatggcgtgattgatgtagagcgtttcgacttcaattcatttaacgaaagcactgatcttgaagtaacgcttgaccatgcttttgacctagtgggtgaatatccggatgaggtgctggtcgatactctctatcgcacgcgagataacatcaatctgtgtaagaagctaggcattaaacttaatgggccaaagctgggtcgaaagcccaaacatgtggatccgaaacagcgcaaagccgatgtcagtgcggaaaatcgtcggggtgccattgagcgcaagtttgccttcttgaaaggttcacttgggcttgacttagtgaacaccagaacggctgagtccttggtggtaacggtggatagcgcgattgcattggcaaatatcgacctcctccttaagcttttttctgtaccaatttctattgtggtcgaacagggtggcctgcattatcaaatcaactataaagtgactgaaattcggccagaaaccgcaacctaaatcaccagccactacgtaggcaactccctattttttgccaatgatgcgaagaagtccgggtaattatcttcaactaacttaaatgaatcttcgtgatcgtttgccaatgcgattcgttctttcaagttaaaatcaacagctcgctgatcaccaccgaccggaagtactaagtcatgtgacttggtgtccgttgcaattcgttgtaaaagagttgtggcatcatcattttcaattagttcaactccggcataataaccatttttaatgtttgccgctaatacccttgaaccatcctcagctgtccaataaaagtaacgtgcatccttctcgtgaggcataccgcgccaaaaaacagttgcggtgatgtcaaaccccgaatagatcttgggcatatcttttccctgcccaaaagagtccggtaaatacccaactttcatggccccgcctaaatccgcagctaatttatgtcccaactgtaaattgcgaacaatcgactcaccacttgtcaccatctcatcaatctgggtataccatggaccgataaaaagtcgtcgagcttgaacaaattgacggatctcatcccgcttatcaggattcgtttgtaggtaatcatcgataatcgccatttgtccatcaagaagataagcgtccagctggttattagtaagagcttgcaatacctcttccatatgataagcaaattgaacccttgcatgctgacgtgtgaagtaccattcaaaatcccaatgggtatgggctataacgtgaactctttgcatttattaaacttccttttttcgtcacaatttacttatactgtttatgccgcagacgccatttgacgctcattgcgttgattcatgataacgaatggcgcatataacaggacatcgaatataaccaagacaagtgcaagaatgactggactcgtatgcaatccgcctaaaatccatgtgctaaagaaaattggttcgttaccagaattcaagaccaccagtggaaccacccagccgatagaggtcacaacgtatgcaacgactgcattgaacagagggacaacgatccagggaatcaacataatcggatttaaaacaatcggtaaaccgaagataaccggttcattaattccaaaacatccgggcactaatgctaatttcgctacttctcgctctttttcacctttttttgcaaaaatcaacatggcaatgattagtccaaatgtcgcgcccgaaccgccgatcatggcataaacattggtcattgtattcggcgaaatagtgatgtcagcaaaactaccgaagataaccggttcattaattccaaaacatccgggcactaatgctaatttcgctacttctcgctctttttcacctttttttgcaaaaatcaacatggcaatgattagtccaaatgtcgcgcccgaaccgccgatcatggcataaacattggtcattgtattcggcgaaatagtgatgtcagcaaaacttttggtttcagcaaacttagcaacattttgtagaaatagtggtaaccagaacgcagacacgacaccccagacaatgttgaagccatgcaagccaaggaaccaaagaatctgctctaacaaaatcaccacgataattgctggtaagcctgtccccacggttaatagtggtttgatgataactgtagcaatcagttgaattaaacttgcataacccatcgcttgcagcccaattcgtgcaagtccaaacaacagcaacacttccgccattggaatcaaggcaaagaatgaatcaaacacattttgtggaacactccctggcattttgatcgtaaactttgagcgactgaaagcggcaaacattgccacggccagcatgccgacaattaatccagtaaacataccttcgtaactgaaaaatgatgatgcaaagccttcaatgatcttggcttttggatcagcaaagttaacattgttaggcaccatcacgaaataagcagaaaatgccaacagcgttgcgataataatgttcatatttttgttttcatcgcgctgtttcaattccaccgcataggaataagcgctggatataacgacgattaaaccaacgatccctaatgtcgctgttcccagataaccaaacaagttactgatgcttgttaaccagccccaatgcaaatgttgcgctttaattaaggcatccagctgcatcttaatcaaattggaaaatgagccgataaccgtaaacggaatcgttcgcacaaaagcatttttgaccgcttgtaagatcgtgttgttctgcacccacattgatgccttgagcaacggttcctgtattttatccacgttgaacttcatggtaagtcacccctatgtcaattttgtttaaaccaacttcttgcaataatgtcagtttaaatgcgctttcatattttgtaaagacttatttttaagttgtatatacaaatagttcaacccaaaaatatatttatatacaaataatttaattctcgaatgaatgacctaccaaataatccacttgtgttataatgtttgaaccatgaatttaactgaggtgaaaccgttgtatctatactgggaagtctattctgacataaaaaaagatattctgacgaatcattatcgagcaggcaaaccattaccaactcaagaaacgcttgccaagacttaccaaactagtcgcttaacgatcaaaaaagcactgcgaattcttcaggacgaaggtttaatttatagcaaacagggatcgggcagctatgttcgcgcacgagcgactgatgatgataaagaactcttaccactcgatgcccctattggcgtcacctactcgcatcgagatcaaaaaatcacgagcaaactgctttattttgacgctcgccttcctaatgaaaccgaacaaaaaaatctggtaatcaaggggaacgagccaatttatgacatcaagcgcgttcgccttgtaaacggacattactacagccttgaacacacgactatgcctacccatatcgcgcctttggaccggaaaattctcaaaggctccatttatgattatcttggcagtattgggattcaattaactgatgctcgccgggttttatatgcaacagaggcagacaaagaaaccgccgatgcgctacacatcaagcaaggaagcccggttttagtcattgaacaaactgcttacgatcaaaagggtcatgcttttgaatattcggtctcgtcttttatccgcgaccactctcgatttgttttgaatgttcatcgacggtcaccggacatgccacattaacagcgccggacttgctacgctggcaaaaaaaatcggcacttgagattaactctcgatgcaccgattattcataacctttttcactatcgtctcttcgatagtgagtttttttatttcaatacacgcgacagaaatccgatcctttagccatgtaacacataagctatctatcaccattatttgtcttattcaatttaaaatccacatgatacgagtcttatatttaagcaaggagttcaacgcctgcatctgctaattctctccctatacccatcccaggatcttcatctgtgataacagcttcaagcgactgctcactgcacaactgataataactttttacgccaaacttggaatgatcgcataatagaatggttttttcggctcgttgcatcatcgctcgcttgacgcttgattgctcctggctagacataaatacaccgtgatcagccaagccaacgcatgacataaaaaatagatttgctcgaaaattacttaaaaacgcaattgaatcgtcacccaaaatagacccagatccattccgcaagcgtcctcctgttaaaaaagtcttgatagatggcaaaccgtctaatgcaacggcaatccgcaaaccatttgtaatgactataacatgatttaattttgctaaataaggagctagaaaggatgccgttgaactagaatcgatgaagatggcttgattatcactcaaaaagatactagccgttgcagcaatttgccttttttcttgttctctttcttgtccgcggaataaataaggcaattcaagattgtcaggcttaaccagttctacatatccaaagccacgccgcactttgtccatcttttctaattcaatcaaatcacgacgtaacgttgaactgcttacatataattcttgttctaattctgatgttcccatccgcttcttgtgctgcaagacggaaatgatcctgtttaatcgctcgtttttaaacaaactaatcccccctcttataattcaacaacattctaacggcgatcgtaagcgcttgcaagaatgacgcattatgaagaattgtggcgcttttccatcgcataatcagaccattagtcaacatcagtgacaaccgtcaatatatcaatcttttcaagctataatgacactatccaatacggaaggaagtcatgaacgatggaaatgatgtttcaggccgaacgtactgatcttgcccatacagtgcaagtgatgttcgatcgtaaagataccaatgttgctggcggaaatatgtcaattaaagtttttgatgagaatgagcatccctatatccttatcacacccacttttatgtctgaaacctattacgctgaattgcatcctgcacagatcctagttgttgatgcaatcaccggtcagaaaattgatggtgtcggcgatgtaacccgagaaattaatatgcatgaaaaggcttacgcaactcatccgggtattcgctgtgtttatcattcgcatgctgaagaatctatgttttgggcaactgccggactcgatatgcccaatgtgaccgaagcaaccagagaactcggacgtataagggttctcccctttgcaccagcaacttcaatggcattggctaatatcgtacatgatgctctgcttgaaattggtgacaaggctatggagaatgtctttttacttgatagtcatggtattgtgattacgagttctgacttgcatattgccgttagaatcatggaaacacttgaatggaatgctagaattgcctatcaacaagcaattttcattaaattaggcttgcttgacgattttcactcttgtggcggcaattacaaagatccttacaaagaggttccgccaattgcggtccctagtactccgattaagtcaaaacaagtacctttgccttccaatccaacaagacctgtcagcgaaatgcagttaggtgaagtagagtaactgacatttatcttcttaaaaatgacgatcagagattaaccttaaaaaaagcagcaatgaggctgctttttttcattcaactgctaaagctttgatccatacgaagaacatgctaatgacgtccaagtttagaaggatcgttgaattttttaaaaaccgtttcacgaaaatcactttctcacggacttatcttttcacataaatcaacggcttcttattatgcatacataaaatcagcactaggaaaatcgatctcctagtgctgactttcgtttgttttgcgcttgcttcttctcagttgatcaactaataacacccttcttaagaatcaagttcccatatagggcctgatcgccggtttgtacaattgcaaagcattgtttggaatgttcataaaactcaaatcgttctaaagacttgaactgatagtctgagaatgacttagctatctctgttcgatattgatgccagactggcggttcaccattaggcacatgtttatcgccaggaactacctcctgaacaattgcttgataatccgcgtatgaatctaatggcatcaagactaaaatatcttgcaagaggtctaaaactgtcaggccatctgctcgaataacgtgatcatggttggtattagcaggatagttggcatccgctaacagaatttcgtcgccatgccccatctccatcagtgttttaactagttctggagataatctcttaggaatattctttaacacttgctcacgctcctatacttgcttggtctcccaatagagttcaatgtcttccaatgttctgcctttggtctctaggacattcttatgaatatagaaaacggccagcgcagacaaagcggcaaaaatatagaaaacgttaattcctaaagcctctagcaacattggaaaaatcaaagaaagaatgccattaaagaggtactgtgtgaaagtgataacccccataccaagtgcccttgccttaagtggcaaaatttccggtacgtaggaccaaaagaccggtcccaatccaaaaccaaatgcaaagacataaacgaaaatggcgacaatcgcgatcgttgcattgtcagaccatatacataaagcaatagctggtggaacttgaccaccgagacttatttctaacagcttttttcgcccgaggcggtcaataaatggcagcgataaaaaggtggagacaaccaacgcaccaccaacagcgaagtcagcgagaatgctagcattagccattcctaagttatggaagatttccggtgcgtaataaacagctgcattgatccccgtaaatacctgaaagaaggttagaacaaacagcaaaatcataaccggtctaaaagtgccaaacaattcgcgcaacccagcctcttgcgatttcaagctatcttgaatatctgtgatttctgactcaatctcgtcatcggttatccgcacgcgcttgagcactcttcgcgctttttcaacttgattatcacgaattaaccatcgaggactttgcggcgacaatatcataccaacagcaaagaccgcagctggtatggccccaagtccaagcgtccatcgccagttgtcagccgggaggttataggccccgacagcataagccattaaaatcccgatattaacactcaactggtacagcgaagacattaagccacggatatgagccggcgctaattcagaaagataaatcaacccgtacatgttggcaatgccagctgcaacacctaatatgaaccgagctaccatcaacatcatcgtgtcagccgacaaagcactaaaaatgctaccgccaatgaagataaaaccgccaagtattaaaacgtttcgccgctctatcttcttttccatagctgtaaagacaacaattgatggaagtgcaccaaatagtaagaacgaaacaactaatcctttttctgctgagtttaagccaaaagcggttgttatggatggcaaggcaagtgagatcgcccctgagtcgtaaccatacaataatcccgcaaatccgccaagaatggcaaaaagataaacaatcggtttcgttgctggctgtaataacggtttcttagaatccatccccagtcaccccatctcgatcttcggttccagcagcaaatctaagtcctgttcttgcttaagaagcatttcaaatttcttgagccggttctcaaacgactcaactcggcttggccggtaagtcttgaccgcgtaggagtgattcataatgttgacaacgtgatccggggtcgtttgtttcaaaaccagtaattgcgaaacgatatttcccaaaacacttgcctcaacaggcccagctacaaccggcagctgggtcaaatcggctgttaattggactaacaactgattttgaataccgccaccaaaaatatgaacaactttgactggctctccggttactttttgcaaatcatggatcgtctttctatagaccatcgcaaggctttccaaaaccactcttactaattggccacgatttttaggcagctgttggccggtttgctccaagaacagctttatcttttcttccattcgacccggctcagcaaataatggatgattagggtcgatataactattaatggacgcagcagccttagcttcagccgtcatcttgtcaaaatcaatcatcatgcccttataggaccattcacgttggagttcttgtatgatccagagccctgtcacattcttcaaaagtcggtttgttccgtcaaaacatccttcattagttagtcctgcatctgcagcatccatagtcacaactggatctgttgtctgtcgtccgatgatcgaccatgttccacagctaataaaggcagcccgttgtcgatctttttcttcgattggcaaagctaataacgctgccgcagtgtcatgaccaacaccattaatcatctgtatcgtagaatctaactgtagttctgcgataatgtttggttgcaaagggccaagaacatctcctccaaccgttaagtcaccaaaccactgttttggtatccccaacgattttagtaactcagtgttccagtcgcggctctgcgcatcgagaaggccacttgtgctggctattgtaaattcactttgtttaacaccggtaaagaaatagccaatcaggttaggcatcatcaaaaatgtggtgcctttcgtcagtagaaaaggataccgtctaatgtcggcgaatagttgaatattggtattgataagatccggctggtttcccgtagttagaaatagctttaccgggctaacacgttgatagaatttttcttttacctctgttgttctcgtatctcgataactgtgcggtgcaaacaataactcgtcatggtgactcaaaagtccataatcaacaccccaagtatcgacactaaagctgtcaatttgcttcaagtcacgttgcgctatcgttaatccgtatttaatttcctgaaaaattttcaggtaatcccaatatagatggtggttgacattaactggttgattagaaaatctaaactgttccttcaataaaactcgcttaccatcaaactggccggaaatgagtcgtccagaactcgcacctaaatcaactgcaattaagtttcttatatccatcctcatcactcatttccaagactatcgatacaatggaccgaagtttttgcatgcattgaagtcagccgcctctagattttccgtacctagtgatgcccatgctcgcggacggaaaatactggattccggcacattatgcatgttaactggaattcgtaaaatcgaagccaacgttattaagtctgcaccaatatgaccgtaactaatcgcaccgtgattagctccccagttatccatcacatcatagacagacttaaacgcgccatgtcccgtcaaaattggaacaaagaatgttgacggccaacccggatctgttcgcttgttgatgatgtcaaacacattttcaggaagatctaccgcaaaaccctctgcaatctgtaattctggaccgacacctttgacaagattaatccggctcatggtaacaggcatcccttgttctccaccacgtgttacatagttagaagaaaaaccaccgccacggaagtaaccaatatttgctgggatccaccgcgtgtgtgttaaattagcctgcgcttcttgttcggataattcgtaaaaaggtttaatagccggttcgccattgatcgtctctcggcctgtcgcatcaagtgtttgggctccagaattcgatagatgcaggaacccatgcttagccaatccctcaagtttagtgcctgtcactcgttcaacagcttcagggctccaatatgtccgcacatcagcaaagatttgcggcgtgttggttagtaaataattgaataacattgaagcaccattcaacgagtcattttcagtagcaaatacgtgcggttgatgaatgccattccaatcatactgagagttcatgaaggcttccatgtaatcgccattaggaaaatgatctgtccattgtcgttgcccctggaatcctgcagcaattgcattatgaccttccgcttcttctttaaaaccaaggtctgctaatttttcgttaccatccatcagatcacgagcaatgatcgtcattttgatacagttagccaattgttcatgcttctcttcatcagtgaacttgttaggatctttttcgttataaatatccgggccgattggtgtattcttttctgcccacgccattgcttttttgaactcttcttgatcataaatgccttcgtcccaacgacgaactatttctgacatatcgacgtattcattccgcatccctagatattcttggaaaaagtctggatctaccgttgaccctgcaattcccatcgctacgccgccaatcgaaagataactcttatttcgcatcaaacccgctgccaatgctcctttagcaaaccggataatttttgtttttacatcttcagggattgtggtgtcatcagcatcttgtacatcatgcccgtaaataccgaaagctggaattcccttttgcgtgtgagctgccaagacggctgcgagataaaccgccccaggacgctctgtaccattgaatccccaaatagcatgaggtagatccgccgacatatccatcgtttcactgccatagcaccaacaaggtgtaactgtgatggttccacaaattccggcgcgatcaaatttttccttagacattgctgcttctttaacaccgccaatggttgaatcagaaataacagtctgaacaggtgaaccatctggatatttaagggttgattctaaaagcttggcaactgaatgggccatgttcatagtctgttcttctagtgattcacgaataccacgccggcgtccatcaatcgtcggacgaataccaattttaggaaatgtcacgtttgtcatttattctgcctccaagtttgatatctaccaaatctaacaatattttgttcatcagctgactacggctataataataagcgctttcattcaacgcgccaatagattgcacgattaacggcttttcttcaaaaaaggtcgtcaattttcttcacagttcatcaagcttattagcccagacacataaaagttcctataccacctcatcggcgaaaccatgtatagctttcatccaacccaaaaagcccaccaattgccttcaacaatcagtgggctctttagagtgtgtttaggaggtatcctaccatgagcagataacgttacacttttagcgttacctgactgatgagtgaatcaccgtgaagaaaggctgggttaggcgttaagtcaaaccgtttggccagttgttccagattttcatccgtgatttcgttgatgatgcggccgccttgagcctgaatagcggtgtaaattgtcgccgctttttcaacggtttcaattaagccatacgtttcatcaatggaatcgccggcgccgaagattccgtgttgcggccacatgacgattcggaaatcggccattttttgggcggttgcctgaccgatttcgttggtgcctggggtcatatatggcaagacgccgatgccttcggggaagaccacaatggattcagcctgcatcttccacaaaatgcgggaaaagagcttctcttccagcggcagcgtaaaggacatggcaaccagattggtaggatggcagtgcatcaccacgcgctgatttggatcctgctttagccgttgaatgtgggtcatcagatgagccggaaattcactggttggctggccgccgtcattgaagccccagagtaggtcaacgctatggccatctttggcaatttggactaagccggtgtcgcgggccggaaaatccttgacattcttgaagtagcgtccggttccggtgaccagaaaatactggcccgccagttcactggcatcgaacttaattggcaagttgcgcttgacttcatgcacatcaccataaggggcaatttcagcagccgttaaccggtagctgacatttccgccattgcgttcatcccagccatgttgataaaggttccaggtgactttgcgcatttgtgccacatacggtgactcgacaaagctctgggtatattcgggattcagaaattgtttcttgttatccattaggcgtgttcctttcagaattgacgaattagtggaccaacttggcatcgcgtttgaattgaacgtctttttcatactggtgaatgttgttcatccagtcgaagccgaccggggtgttgtgatcctggcagaacttgtcccaaacagcgccgaatgggaatgacttcaattcttcggtttcaattaagcgggtggtgaagtcagcgttgagttcgtctttcttcaactggtcaatcggtgccagcattgcctgcagcaagctcttttgggtggcccgggcacctacgacccaagctgcgacccgattgatggtggcgtcaaagaagtcaaggccgatgtgcgtgcgatcaagataaccgtcccgaaccagtgaccgggtaatccgaatcagcgcatcgtccatgatgacaacgtggtcagagtcccaacgaaccggacgggaaacatgcatgaacaaacctttgccaaatgggaagaaggcgctgaacttgtcggaaacatcttcagttgggtggaagtgtccggcgtcaattgtccataacttgtttcgactgatcgcatagttttgatagaattcgtgggaaccagtggtgtaggattcgattccggtaccaaacagttttccctcgaaggattcgatggtgttcttttctggcagcggatctttgatgatttcgtccaaggctttgagcaagcgcagccgtggggtctttttgtcaattgggttgtccttaaagccatccgggaaccagaagttattaacaacctgactgcctaacttttcgccaatgtagttggaaatttcccgactgatcttgccgtggcggatccagaagtcacgcactttgggatcgggtgatgaaaccgtcatgttatcctttaccattggatgggagaagaaagtgccgttaaagtcgagaccaacgccttcttgctttgcccagtcgatccagtaatcaaagtcttctggctcaagtgtatcaagatcgcgcttcttatccgttaccgcatagatggcgtgcagctgaacccgatgcttgccgggaatcaggcttaaagcttcgtgcatatctccggctaattcatccggtgtgcgcgcaatccccggataattaccggaaacgccaatgccgccggttagttcctggttagggaataggaacccatgaatgtcatcgccttgccagcaatgaacggacaaaggtaccttttccaattccttcatggctgcatcggtatcaactccgatttctgcgtaacgctgttttgcgacttcatatgccttatcgacttcttctggtttaaccatgtgaaaaacgctcctttatttaaaatcatctattgtgactggttaccgcatttaaacttcgactcaatccaagtggaacacttcatggagatcatcggcgaccggactgttatccgggttggtcttcataagcggctccatatacgcccaccacttcttgcaaatgtcagtgttggcaatttcgttgtacttagcaacgtctggcacttccagataggcaaacaattcgccattggccttgttgagataaatagaataattagtggcgccatatttcttaagggctgctttcatttctggccacagctcgcgatgccgcttctcatactcctcgtatttatcgggataaacgtacatgacttgcccaatacgcttcacgactaaaccgcctccttagctgtctgaaccttgactgttttcataaatgccttatatttagcgaatacatccggataagcggatgaatccggttcataagtcttcaaatcaaacgatgccttaattagcttgcgcccggcgacaacatctttagcagcgccggtcgtaatcatctgaacgagcagattaccaattgctgtcgcctcgcttggacccgcgaccactttgacatttgcgagatcagctgtcagttggttcattaaggttacattcgaacctccgcctacgatgttcagcgtatcaatcggatcggcaataatggtgctgagcttgtgaatctcgttggcataataaagagctagattttcataaaccgcccgcgtcagttcacctggcgtttccagcttggcctgtccggtttcggccacataatcctgcagttctttaatcatgttagcgggattttcaaaccgcttgtcattgatatcaatgaagacgcggaatggcgctaccttgtcagccatttccgccaactctttgaagctatactgatcgttcagctcgcgtttgatgcattgcacaatccacaagcccatgatgttcttcaaaaagcgataggtaccataagcgccccattcattggtgtaattttccttgaaggcatcctgaccattttccggggtgttgagttccgcccctagcagcgaccaggtaccggaacttaagaaggcccaatgattgccgaatcccggcgtaccaacaaccgcactcgcagtgtcatgcgtggcgacggtaatgacatcggtttccggaatatcgtatttcacatgccatttatgactgatcttgccaagcggcgtaccggattcaaccaatgccgggaactgatcctgagcaacattgacttctttgagtaagtctttatcaaaaagtccctgccgcagattgagcatttgcgtggttgaggcgttggttacctcggtgacggcattgccggtcaggacataaccaatgtagtccgggatcatcagaatcttatcggctttagcaagatcatcgcgctcttcagtgtaaagttgataaagtgtgttgaagtcctggaactggatgccggttttttcataaatgtaggattttggaagctcagatgtcagttgccgtactgcctgattcgtgcgtgcatctcgatagctaacaggatcgtgcattttcttgccatcattaccgacaaggacatagtcaacggcccaagtgtcaattcctaagtccactgcggtatagcccatctttttgactttttccaagccggcaaaaatttcatcaatgatgtggtcgatttgccaccgatcatgccccgcttcgtttttgaagccgtttttgaatcgatgaacttcggttagtttcagttgaccatcgacaatcgcacccagcatgagccgcccgcttgatgcgccgatatcaactgctacgtatgctttcatatgctgcacctctctttaacaccatttgtttggttaattaattgactgtggtgaaacgcgttcgctgccggtgtcttttgcagctgtgtcgcggtcggctttgctcttttcatcgtcagttaagaacttgtcaccatattgttcgcgggtaatttcttcaagactcttgccacgcgtcttaggcgtccagattgtgccaatgacaagtgatactaatagcagtccgatcatgaaagttccggcaacggtgaagccgaggctgttgagaattgccgggaaaataatggaccaaacaccggcactggcacgaaccaggaagaacatcacgccttgtgagccagcgcggaattgggtcgggaagagttcggttgcccataatgcataccatgcttgggcaccgattcctgcgctaattccccacaatgctacgaacgcccataagctccatgactgagccatgccggcgtaggtcaatacgatccaagatgctgcggccattgcggcgccaacgaagaagaaaattcgatggttggctttgtcaccgtacttagcgaatccaaagtacgttgccaatgcggtgagaacccaaagtacagcttgcagtaggttagtttcctgattagacaagccgccagcagtttcataaacatatggcatgaagaagcccatcgctccggctaccaagttccagaacatgtaaacaccgactaggaagcatagccatttaagtgaggttttattcgagaacaaggtgcgataaggatgcgacttttcaccggagctcttttcaaacgccttttgatcctgccatgcttttgattcgccaagtccacgttgcaagagccaagcaatgaaggcaatcacagtcagcaatccgaacaatatccggttaccaaacagaccaagtggtgcaagaacggtcccgagaatgaaaataactgccggtcccaatgaccatgcaaactgtgatacaccaatattctttgctcgattgtcatcttgtgacgtttcggaaatataagtccaacttgcaggaacaccggcgccgactgctaagccagttacgagaaatcctgccagtaacattgggaagttaagggcaaacatgaccaggatcgtgcccaccatataaaccaacatgtcataggtgtaaatcaacttacgaccaaacttatcagacagtggcccaccgatgagagcaccaagcgctgcgccaaatgcgttggctgacaaggcgcctaataagccgacttgaaaactgctgagtccaaaatgctgcgtccacagtgtcaagccgctagcaccggcaacaatactgcctgaatccagaaaattcgtgattgaaacacgaatggtggatttcaacgagcttttctctgaagccattgtgttacctcctgcacatttcattttttgtcaccgtttacagttcacatttaaccgcttacatgttatggtcacaatgtcagataaatattatgatcggaacataagcacaggagggtgccatggaattagcaattttaaagcagttgcaaagtttgactgatgtcgaaaaaaagcagaaggagcatcatgtttttagcgatgacattccgccaaccgcgattgacttgcgggaatcaaaaacggctaacgtcccggttttaaacgattattttttccgcaatcacgccatttatgtcagcaaacataatcgatatgccccttatcctttgcacacccatcagttctttgagatgaactatatgttgcaaggacacgccgatgaaacggttaacggtcagcgtgtccacctgtcacaaggcgatgtgctgctactggatatcggaagtgagcatgccattgatgcgttaggcgacaatgatttgctgatcaagattttgtttcgtgatcgcaatatttcaatcgatttcctcaaccagattcaaagtcagcaaagtgtgctttatgatttcatgattaatcatttacggaagcaaaaaaccaagcagcggtatgttctgtttcgcaatggttttcatgacattcaaatcacacttgagcgcatcattgaagaatatttccgcccgcgcgcgttttcggatacgatcattcagtccgagttaacggttctaatagcggaactgattcgtggtcatcaaccaaccatcaaggatccttcgccaacgcaaaaacttgcggtcaagttgcttaacgatatccacgaacattatcgggacttgtcgcttgaagatttagcgaataaatacgcttataacaaaaactaccttggtaatctgttctcaaaagaagttggcaagaccttttccgaagcactgacgcaagaacgactcatcaatgcgcgccgcttgattcagaacaccaagaagcccattagcgagatctgtcttgaagtcgggatcagtaataaaagcttcttttaccacaaatatcacgcgctattcggcaatacgcctaaagatgatcggttgcacactacgggttacatttctcctgatcacaccaacccaccgttaacaattctgtaaatctgtttcgtttttgtttcacactttgccgttgcaccgcaaaagcattaagcgctttcaccgtgaaactaaaaagtcaagttaaacattgggacatatccttagatgtttgtaaacggcgcttgataattttctttattgtgaaacaatgaacgtgtaatcaaatgatgagcaagtgaaggagagattgcaatgaaaatcaaagcagccgttgttgatgaaaaaggtgctgattttaaaattcgggacgatgttgaactagcgccgatgggtcctgacgaccttcaagtccatatggtcgccagtggtatttgccattccgacgaagccttacgtatcggggatgccgttatcggctacccgattgtactgggccatgaaggttcagggattgttgaaaaagtcggcccggaagtcacccagttcaaacctggcgatcacgttgttttaagcttttatgcctgtggaaactgcaagaactgcttgaagggtattccgacccagtgtctcaattacgcccataacaatttgtccggtacccggccagatggctccgcgcacttcacggaaaatggcaagccggtcgcagacatgttcgaccaaagctccttcacaactaccacggtcgttcgtgaacgtaatgcggttaaagttgacaaagatcttgatttgcgcaagcttggaccgcttggttgcggctatgtcacaggttccggaaccgttttgaatacgctcaagccaaagcctggtgatacgattgcggttaccggtactggggccgttggattagccgcaatgatggcgggcaagatctccgggtgcaccaaagtgattgcgattgacattgtggattcccgactcgaattagccaaagaactcggcgcaaccgatgtcgttaatagcaaaaccgaagacccggttgccgcagttaaaaaattgactggtggcctcggggttgactgggctgtcgacacaaccggcgtcaaggcagtgatggaagatacaatccagatgctggctcaaggtggtaccaccgcaacgatcgcggttacgccgcatcatattgacgttgatacctggaacgacctctgcgtcaatgacaagaagatcgtcggcgtcaacatgggcgactccatcccacaaattgacgtaccgcgcctaattgagttctataagcaaggtatgttcgactttgataaaaccgaaaaattctatcaattcgaccagatcaacgaagccaatgctgactcccgctctggcaagaccattaaaccagttttgattattgataaagactatgtaccgggtaagtaattgagcttttgtcttggttctgcctgtggtttgaatttaagcacaaaataataaagcaccaggaactctaacgctgagtttcctggtgctttattgtgttcagccttctttgtttcattaatctctggctttaggcggaacctcattgatcgaaattcgctcataatgagtcacaccatagcgcgtattataagtcaggcgcagtatttgtccgtcagagaaggggccgggatcatactcatccgtcttaaactcaagtagcttcccgcgcccagcagcatctttcgccaacgctcgataaacgtaacatttttggcgcagattaaccggaactgtcaccgaaaattggctgcgtggttcatgtacttttgcataataggcgacaccaccatctctgtacaccgtccaccaaagcgtaagtgcaataaccaccgccaatgcgctcacaaagccaattttataaagtgtctcctctgtttcaaccgttaatcttctcaccccgagcatttcctttctgctttcaaaaagcaccttgatcaagttgaaagaaactgttcattgctatttaacaagtttgaaaataagcaacttgactgcgaattatctctagtattcagtcctggcgctccttaggtcaaagtaccaaaggaagttgtgtcggtaaattattcggttgtttttttaagagatttcttacacttataacaatatatgttattaatttggatggtatgttttatccggattgctgatgttagtaaaacattttttcaatatgactgattatgtgaggcttgaaagtatggtgactcccaacgtattaaaacatcactccgcagccgatgcctgagcatactcattcataatcgccgtattggcctttgtctccacattacccgcatagttcggtgtcaccaatgagacggtgccgtgtgcgttgtaaaacagataaaacttatccccaatcatgttcgctgcggtttgtgaatggctcccttcatcggtaaacgatcccactttaatctcggtgttgcatttgacggtccgcgtttggcctgcagcgtcagcactgaagaccttgattgttttagttgcaacattgcggatggtcgctttcatcgtgacggcatccgcatgttgatactgaatggtcaggcgataatttgctgtctgcgggtccgcttgcaactcaatccgagtcggtgcattcacgccttgccgtgtaaaaaccgcccctgaacgttcccgcaaaagcttggcaacatccacaacataatcttgactaccggctgttgactgagaactgcgctcccgactctcccccatatcgcttggtttgaccgcgctgcttttacttgcatgctgctttgaggtcacctttttgatcgcgctctgttgcgattcagtcattccgcgcttcgtttgttgttgggcaacataaaaatagccgccgataatgcccaatcccaggatcaaaactgctaacggcgccatccactttttcttaggtggtcgttgacgccgtctgctttcactagtctgtttcaagcttaaaaacctcacttaattgttcgcgttacgctgccttatcgactttgttagctcatagaaaaagtataacatggcgctttttaaacattatagttcggctcgtccgtacgcttggcaaaacaactaaacctttacagcatttttactgcacatatggtttgaacctttatactgaaactaatgatcatcgtctgtttgtctgtgcaaaaatcggtgtgtgaggagctcactggttctcaccagacgctcaggttcaggcccatgctcactcacaaggaggttctttttccatgcacaaaagttggtggcaagaagcagtggtttatcaggtttacccccgcagttttcaagatagtaacggcgatggtatcggtgatttacaaggtatcatccagcatttggattacattaaagaactcggcgttgatgttatctggctcaacccgatttacaagtcacccaacgccgacaacggatacgacattgcggattatcaacaaatcatgccggagtttggtaccatggccgatttccaacaactgttaaaagcagcccacgcccgcggtttgaaaatgatgatggatctggtcgtcaaccatacctctgacgaacatccttggttccaggcggctaaacaaagtcgcacggatccccatcatgactggtatatttggcgcgatcccgtcgatggtcatgaaccgactaattggcgcgcggattttggcggctccgcttggacgtatgtaccggaagtcggccagtattatctgcacctttttgcggtcaaacagcctgatctgaattggaccaatcctgctgtgcgcaaggccgtttttgacatgatgacgtggtggtgtgatcaaaggattgatggctttcgaatggatgttatcaatctgatttcaaagcctgatgtttttgctgatgatccacaccttttggaacagccaaacggtaactcgctgggcttaattgccaatggtccgcacgtgcacgaatacttacgtgcgatgaacaaggcggttttgtccaagcacgatcttatgacagttggcgaggcacccggcgttacgcccgccttggcacttcaatatactggtttcgatcgccacgagcttgaaatggtcttccagtttaaacatgttggccttgataacgatccacaattcggcaagtggtcactcaaacatcctcagttgaccgatctaaaacgcgtcctatccgattggcaaactgcactacacggtaaggcttggaacagtttgtattgggataaccacgatcaagcccgcgctgtttcgcgttttggggacgatcgccctgcttttcgggttcactctgccaaaatgctcgccgccactttgcattttctggaagggacgccttacatttatcaaggtgaagaacttggcatgaccaacgttgccttcccatccattcacgattaccgcgacctcgacaccctaaacgcttggcatgaacttgttgaacagcaacatgctcttgcgccagaagatatgttaaaaagaatccaccgtcgttcccgtgataacgcccggaccccgatgcaatggtcacctgcaccgcaagccggcttcaccgcaggcactccttggctagccgtgaacccaaactacacggacattaacgcaaccgctgcactggcagattccgattcggtcttcttcttttatcaaaaactcattcggctgcgtaaacaataccctgatctgattgtttacggcgcttacaccttactcgacccagacgatcctgatgtatacatgtaccagcgccacgccgccaaacaagaactgctcgtcatcagcaacttcaccgaccagacgttgactcgcgatatcgccaaacagctgtcaccttcagccaagctactcatcagcaactatgacgacgacgctgaaaatacgctccggccttatgaaactaaagcgtatttgaccagtgagcgatagtgagttcacttttgatctttaaaaaacgcaacgaatctcattcggaggttgtcaaaatcccgtcctcaccgatttttcttcatgtagaacgcgtctacttgccattacgtaacgatgcggccacatcaagataatcatcgtgatggcatcggttgattcgattctcttttaacggccgtcagccaacttgctactggttatcactagcttcaccgccaattagcaatagttgctggccgttatcggggacgcctcaatcgcgctttacccgtttcttctcccccgggggttctttatgcaacagtgctgttgcgttacataacataaatcattaaaagagaaacgcaaatagttgccgcagttctatccgcaggcgccctacaaatgccaaaccagtcatggatatcatcggtgccagtggctgatcaagcgaaaggccaacaatgaaaggctatttagcatgccatcatgctttcaccttggatgaataatacaaataccatatcaccgtcacaatttcgtcacatctgctctgtagtattagcaacatagaaatgagccacccactcattcctatacaaaccccaacccaactttttcatttttactcctccaaagtagaaatcgtcagccggcctcccaccggctgaccaatacataaataaacccccgcagtgtgaggtgaagtgcaacaaaaaagttagacagttggaaaattagttacgcagcggtctgattccgatattcaatcggggtcaggccatttttattgagtgaaatacggtcatgattaaaccacgtgacgtaatgatctacgatttgcttcagttcctcaagatccttgattggttgccgattgagccgttctcgtttgagtaggttgaagaagctttccattggtgcgttatcatggcaattacctttacgagacatgctgggaacgatgcccatggcgtgcacctgagactggtattcacgggtttggtattgccacccttggtcagagtgcatgatgggtgtgacgccagcggggagtttcttggccaaatcgtcaagcgttaggtggagttgttctttgttcgcagagttgcgcacaatgactgtaataacctctcgactggcctcgtcaatgatggccgagatatagccccagctgtggtcaagcagtctgacttgcgttacgtcggtgtgcaggacagcgaagggctcctgggcatcgaattgttggtgtaacaggttgtcgttcacggtgcctacttttcccttataggagtgatagccgctagtatggcgagaatacagtgtgacactaagattcaattgccccattaaccgtagaattgtattgggtgagcatttaaagccggcttttcgtgccatcacatgaatacggcgatagccataggtctcatatgagtcatggaaggtcttcttgataaataccttcaaggcggcatatttatccggcttattcttgcggtgcaagcggtcatagaaagtagcccgaggcaactgtgccaatgccaataattccttcaatggatagtcatgccgtaacgcgtcaactactgctgttttttgggcggcagattgttcttcgatacggcccctaatttttttaaaaagtcacgctccattcgcgtatggtataactcgccgcgtaatttcaggatctcttgctggtaagcttccttctcactaagctcaagcttcttaacttgtttgggtttcttatgtttcactgtagaccgccttcctcgcggtttcggacgcaacccagccactccctcagtcttgaagatcttcatccagacagccacctgcgaggcattgatcccgaaatgagcagccgcagataccacacccgcaccactggtttggtaatagtctaccacggccagcttctgttccagagaataaaatgtcttcgtatgctttcgctgaagagattcaagtccatggacttgggcttgcttaacccactctcggactggtttcgttgacgggatactgtatttagtgcaaaggctgttataggaaacccgtccagaaagatactcctgtacaaccttcaccttgaactcacttgaatatttagtcataaaaataccccacaatcattagagtatctgtctaacaattatggggcacttcaaggctgcgggggttttgtgtatcgttttgtactagccttttaattgttctagaactttaacgtttctccagtttaccgacaatggctacccaacttaaaagagacaaatttgattcctctagtacgtacctatcttataaaaagccctaaccgcgatgggcatccaaaatctccggaccatgcgttgttccgacaaccaccgttttaaccagatcaaggaacaagccgtgttcgacaatcccaacctgcttattgagccattccgccaacaaatgcgggtgttcgatccggccaagatgcagatcgataatgtaattcttagaatccgtcaaagctttgctgccatcctcattcaaacgataagctggtttcaggccttcatccgccaaccgctgtaacagcttgccactaccaaacggaatcacttctagcggcaacggaaactttccaagtgtgtccaccagtttggtttcgtccacgatccaaatattacgtgccgaattaatcgcgacaatcttttcgattaagtgagaacggccaccgcctttaatgccttgaaagtgcttgtcgacttcatcggcaccgtcaatggtcagatcaattttatccacatcgtccagtgctttcatcggaatttccaacgattctgcctgtttttgcgtccggacactggtggcaacgccggttaaactaagatgctcttctttaatccgctgagcgatggcttcaacaagataaaagactgtggaacccgttcccaagccaattgtcatcccgtcttcaacaaactccgctgccttttgagcggcttcttgtttcaacttatcttggtccatagctaaccatccttttcgctttgttgtcttcattataatatgaaacgaacggcaaatggtggtttgtgaagaaaatgacaaattgacattttgcatgtttaaccgtaatctgcattagttaatgctttttcacaaacactactcgacaacctataagtaaaagttcaaagcaaaaagggcatttaggtcaataataggcctgatcaaaagcaactccgtcaaggggatgcaaaaaagacttaccttatcaaaccgggtatagcttttatatagcctgtttttgctcagtggttagcgtattcagaatatgattgacccgttgctcgcgtagttgataaagcccgcaatgctccctacaaaaagctgtccggtctttcttaatttcggctaaaatctgatccacgatatcattcgtctgttggtttgcctgacgtaaagcccttatcttagcattacagtcatttcgttttttagccattgataagacttttagaatcgtctgtgccttatattcacgaatcggatggcattcttcaagctggtgttttatcaataaatctttcatcaatcaagtctccctcgcatttgttactttttcgatggggccaacgaaaaagtaagcaactacactgatcggttgagtgttgacgcattctgcaaccactgattaaaaggcgttgactcacatccttcagactaaaattcgtaaatcgtaatcattacgatttacgaattttagattattcccaaagccttgttttgtcaatataagcagggttttaaatggcaaaaaactaataccgtcaaacccttagttaagggaatgggtattagtttttgttttgagactacttatcaggtaattattaagcttcactcatcatactttcactcatcaaatggacctcatgatcagcatgccgcaattcaggccagtactctcgattcgccacaatcagatcgtccagcacttcttttgccacttgcgcactaggcaacgtcttcgatagcgtaagtgcctgccagagttcctgataatcatgatgaatccaagcgtccactaccagcttctctaccatcgcctgattaaggatcatcccgcgctgaaacagtggaattttcccttgcgttaacggttcggcaccatcttttccgacgatacaaggcacttccaccatgatgtcgtcatcaatattggcgattgcgccattattttccacaatgagcaacatgcgttcatgtgtattaaaggcaattgcacaggcaagatccacgataaatgaggcgtgactgtcgattggaaacgcgccgacctcactcgtacccgcgtcaatgatcttttgtgctgccgtgaaaactcgtttttctcgaccgtcctcaacctcattagcgcgtgtgtattcaggatcagaatgggcaacaacataatctgggtataaataatacttgaggtacgtatttggcagatagttaggatccactgcaagcagatcctgagcttttttgtgggtcgcctgccaactcgcatccatgtgctgcgtgtccacttctacttgggtcagataaccgtgatgcgctacatagtctcgaatctgtggtaaatattcatggccggctttatccttgacactcgtccaccagccaaaatgattcatgccaaaatagcgcacctctaaatcttctggttgtaagccaacaatttgtgacatccgccgctgagttccaaccggcatatcacaaatattcaaaattttggcatttggccgcagccggcgacatgcttcggccacaatcgatgctggattggaataatttagcatccaacaatccggtgaataccgttccataaagtcaatgagttcaatgatgtcgccgatactgcgcatcccataggcaattccgcctgggccacaggtttcttgtccgacaacgtgatgcttcaatggaatcttttcatcctgttcccgcatcttgtagccaccagagcgaatgtgtgcaaaacagaagtcaacatcggtaaaggcggtttggggatcagtcgtccaagtaaactcgatattaggtgctttttcctttaattcaatggcgatcgcctttgcaattatcgcttggcgggcttcgtcaatgtcgtacagtttcaaagcccgtaacggaaaacgatccgcattttccagcagcatcatgacaatacctgctgtataagtactgcctccgcctgcaatcacaatagaaaacttcttagtcttagtcatcataaactctcctattcaacttctgctttgtcgaaccctaatgctgcatccaccgcggtccgtactttagtgactgctaatccgtagacaacatggacattgttgccttttttgatcaccccactggcgccggtaacattctttaatgtcgcttcatcaaccagatcaggatcttttaaaaccgttcgcaagcgggtataacaattcgtcacactttcaaagttgtccgctccaccaagtgcttcaataatggtcgcgactggcacatcttgggaacctttgggaatttgtacaggtggcgtttgcttcttcgcctgataatcggctttactataaagtttggtttcttcggtatcttgctcacgcccaatggttttcaaattgaatcgtccaatcaaaaacctgaacgtaaagtaatagatgaagaagaaggcaatcccgacgagtatatacatcggccagtgagtttttccgatacccagtggcaggttatacagtagaaaatcaaggaagccatttggtccaattgcccgaacgttaaggaggttcaagacgaccatgctcaaaccgctcagcccagcatgaacgacaaacagtaacggggcaatgaacatgaacgaaaactcgattggttcggtgacaccagctaagaaagaagtcacaactgcaggaattaggattgccttgactttattcttgttttccggtttcgccatttgatacatcgctaaacatgcgccgatcaagccaaacattttcgaaataccacgtgcatcccagataaccgagcgcgatagtaggtgaataccaggatcggccatctccgcgtaataaatatttctggcaccttcaaaaatgtgaccaccgatttcttcaaccccaccaagcgaggtataaagaaacggcgtgtaaatgaggtggtgtaagccggtcggaatcagcaatcgttccagtgacccataaaggaataacccaaagttaccggtctgattaattacgtggcccaaaccggaaatacccatttggatgaatggccacacataggtcagtgcgactgccaataaaaccgtcaccggaatcagtacaataaagacaaaacgactgccaccataaatctgaaatgcactgtggaattcagtatcaacaaatttgttatggatataaccaaacgtaataccgagaataatgcccagaaaaacgcccatatccagaatctgaaccccaagcaccgctgcctggccggttccttgaagattctcagctttggaaagaattccccgcagctccataaacttattcatggcattgatgaaaactaagaaagtcagcaaagccgtgaatccggcctctgcttttttcttcttcgccaaaccaaccgctaaccccacacagaaaatcaccccaagattggtcagaattgacaccaatgaccccgacaaaatcaaaccaaagcccttggtcactggattattcataaatgggacaacttcaagcaatttttgattcgtaaagatattgccgatcgcgatcaaaatacccgcaatcggtagaattagcaccggcacaaacattgcctttgaaaatcgctgtaagccatccatgaccttttgcttcatcccttttcacctctccgataggcatatttagtaacctgatatcgttgctggtttaaacttaacaaagtatcggtggtatgaaaaccctttcaaagtcattgggaacgcgttacgctcgcttggaacaggttccattcagctcatgaaagccaaataaaaagccatacgtttttcacgtacagcctttctctacactataattgttcgatatccacttaaagctttttgtctttcaagcgcccgatataaaacgtcaaacctgaaaccaatcctgcaatgactggacataacagcaatagccacactgattcaatgccaaaaatttcagcaaaataaccaaacagaccaacgacgacagatacaacaatactggcagtgacaacgcgcttctgatcttgggaactggccactcgcactcaccccttcaaaactttatttcagggtatgccattgtttctgttcatgcaagacttgttgcaatgatggtgcagctaattcagtttctccacctcgccgatctccagctcaaacaaggccagcatctgcgggtaaaacagcgatgcccgttgatttaactcatccagtggaaaatcatccgcgactttaagcgtccagtcagccattttagccaatgtactgtctgcgttaccagtgaaggcaacaacgggaaccggcaaactgctgactaaagccgctttatcaatcacactctgcgtctcgccagactttgaaacaacgataaacaatcccaaatcctctaaataattctccaacaacgcagccgaatcacctggggttgagaaaaaacaccgcttacctagaatctgaaattttttaaacatatactgcccaattacgcctgaaaaaccagccgcatacaggtacaaatattgactttcaaccgccgcgatttgttgagccactgcgcgaatggtcgtcgcatcattttgatcaagcaccgctgattgcaacggatcctcagtagcgtcaacgggttgcatgccggcctcgccatgacgcaacattgtcatcaacttatactgcatctctacgaaaccgcgataacccattttgtgtgctaaccgcatgacggtcgtggccgatgtgtaattcgctttcgccacgccgcgtacgcccagatctaacacacggtcaatgttggccaccagataccgcaaaaccgtgaactcagtctccgtcaaattcttccccgcaaccagcttttctagtttcacaattgtcagcgatcttttcattgttcgtcatgctgatttaacaaccaatcctgcgcaagtgaaaatgttcaatcggcatacgtcaatgtcgtaacctgatcgccatgcgcaaccggccccgctttaatcgcatcgaacgctttcaccttatccatatttgtaaacacaaccaccacagccgggtcacgatttgaggctttaatcgcggcaatatcgacttgcgacaaaacatcacccgcctgaacttcatcccccgccgcaatcttagtctcaaacggttccccgtccatctcaaccgtatccaatcccatgtggactaacacttcaagtcctgctacggatgtaattccaatggcatgtttcgtcgggaaaaccgagctgatgacgcctgaaattggcgcataaactagcccttcttcgggcgcaactgcatacccatcgcccatcatcttttccgaaaaaacgccatctttgagcgcctccaacggcattaactcgcctgtcaccggtgcagtgaaaacgtcacgcttttcttttttgaacaacccgaacattaatcgccatccccttctgaatttaactgaaaccctgcaagttcacgggcgttattttttattgtacaggaaaaaggagaaatatgtaaacggtttctcagctgggaaatacgccaagcaaaaacattgcgatgactatttgaagcatgctatcattatttcagtcaaaagattatggacggtctttttgattgtctactattactatttccaaaagctccatgctcgaaagggagtataggcgtccaccaatactcccctgacaagaccgttcaagacggttgacattaagttgaacaatcaaaggatcgtcgccttcgtcaaaaggttatcgacggtctttttgattgtctaggattgctaccttcaatggcaccatgctataataaaacgcgaaaaccgttcaagacggttgacataagatttgcaatcaaaagaccgtcatcttctccaaaagattagcgacggtctttttgattgtctaggattgctacctccaatggcaccatgctataataaaacacgaaagggagcatcggtggctgccgatactcccctgacaagaccgttcaagacggttggcattaagttgactaatcaaaagaccgtcatcttctccaaaagattagcgacggtctttttgattgtcttgtattatcagcataatggtgatgatcagcgcaatcaacgataataagaaatcaccgaagaccagcatcagcatcaacgcatcagcaacagacaactaggcacctccttccgtatagattttgatcatcgcgcataggcgaccacctcacaatacgttggatttgccaaccgtcattcactttcttgtcttgttcattatgccatacaaaacgtcaaaacgcctgctatctcaatgatttcaggcgttttttaatatttggattgtactttctgatatatcaaacagcgttagccctggagcctcacagccaagagttaaacctcagtcactaatccgccgcaaccagctcactcgcatccaccagtcgcttggtcatctcccacagcttggccacgtcttccggtcgcgtcaggccagttgccttgtcaatgatcgaactgtaaacatgcgggatcacctgtttaacgccggcatccaaggcaatttggagaatcgcttcgtaattatccaagtcaatgccgccagtaggttcgaggttaaaaccttccgcggcacaagctttagccactgcgcggaattcggcttcatgcttcaagccgcccatggggaagaatttgaagctggtgccgcccatgtcttgcaatagggcaatggcggtttcaaccggaacttctgcggccggcttttggctgctcttcggtccagtggcaagattaacgatgccgactttgccagttggtgagaccaagccattaatgacggtctcattttggcctaaaagtgcgcgactggtaccaacgccggtgaaaacttgattaacgtgttggggttgcaagacttgcgaaacccgactcaccatggcgctttgattcgggtcgcctgcgcctaagccaaccgataacccattagcggtcacggcttgatattttttcatatcttcaatcgccgcttcatcggttgcgtagttcttggtcaaaacgccgaccaccacatggccttccgcagcttcatagatgtctttggcattgtcgacggaaccagcgagcacatttagagcgacacgatttttataatagtttggggttaagttcatggaagacaacctttctatgcgagaatttctttgagacgattgacgatcaggtccatttccgcttgatcaacggcacgaatatcgaattcgatgatcccttcattagcccgatattcgcgcgtgtagatagccggatcccctacctttagttcggctgtaacctgcttggcattcttgggactggaggcttctaccgtcaccgcggcccggaaaatcgggcgtccggcgccatcttggacttccttcacgttcaggtgtgacacctcattcaaagcggccacgaatgggtgtagccgcttcttcatcgcgtcaccggactctggaccgtgatccagatattggctaagtgcggtggtaaacccgagcagattttccttgccgattttcatggcccggccaatcccaagtccttgcagtttcgtccaaccgatatacggctccttgccgaaaaccaagcctgacgctgggccttcaatcgccttggccccagaaaacagcaccacgtcaacgcccatttcgacatacttgtgcaaatcctcttccgccgcagcatcgagaatcaacggaagatcgtggcgatgagcaatctccaaggcttcctgaattgtcagcatgcttttttgcaccgcgtgatgacttttcacatagaaaattgctgcagtgttggctgtgatcatcatctccacatgttccggcgtgcacatattggcatacccggcctcaactacctgaccgccgccgagttcaatcatgacttcttccggcgtgccataatcaacattctgtcccttaggcaaaatgatttcacgcttggtataccgcgaagaaaacggatgataaacatgatacttactaccttcaccgataattccggcaacagcttcagcaatcccggccgacgctgagttcaccaccacagcgccttcagttcccagttttttggcaatgtacgcgccagttttatcaaccagatccttcatttcaaaaaagtgggtatccccaaactgctgcgcctgaatcgcggcctccgggactttggaaacgcccagaatggtcattttaccgctagcgttgatcacgtgcttcaaatcgtaagtgctgtaataatctgtcatgcgtgttgttcctccaaatcgtaaaccgccccgccaacaactgtgtaaattggcgcgatgagttgctggccggtttttgtgttgccattagaatccgttaataccttatcaccttttgttaggttaaaaatggtcacgtccgcatcttttcctggtcgcaaccggcctttattcaaaagatggaaggtgtccgccggtgcaaaagtcaccatccgaataacttctggtaaggtatagccgagcagcaacatcttttccatcgtcgtcgccatgtcataaacgggaccattttcacgattgcggtggtaaatatccgtgctcaaggatttaggatcaaggccatgatcgcgggcaatctgcatggttttaaaattaaacgaatctgtcccatggcccacatcgaaaacaaccccacggtcatatgcatcatagacgaattccttgatctcaccgttttcatcaatcatcccatttggcttgccgttataagcatgcgtcagaacatcccccgtgcccatcgcctgcaaaatatctttgagttcaggcggattggccccgacatgcaccataatcggcagatgtccgagcaaagccgcatatgatcttgccgccaatagtggcttgatgccattatcaatcaccaccgaatggctttcacgggccttgatgccgacgataaaatcaggtaagtccgcaaccacatcaaacaacgcctgcttgttgactttatctaggtctccgagctcatcctgcgctaaaataccggtgcgaccgatattgatcagtgcgtaaacattggtctttttagcgcgtgtaatgtcgtaaaaactccgaatattgtccgcaccggttgatcccgcatcgatcacggttgttacgccggccttgtacccatcttcatcgggatcgtcatagtacaaagatagcttttcatagcaatgcacgtgatcgtcaatccacccagccgtgacgtaggattgctggtgtaagtcaatttcctgatgaccgcctgctccttccagttttggtgctaccgcagcgatccggccgccattaatgccgacctcgatcggctgttcacgttctgttttaccgttcttaattaagacatcaaacacaagtgattacctgcctttcgatttgattgtagccatttttggatgcaacgcttggagaagtttgaagtgcgtcaacaagtggggaatctgaacatgaaaatggttactccagtgtgctaggctctccaaaatcttgctcttctgccactctccgaaacgcgcaaactggcacagaaacctgtacataaggaccttagaccgccaatgaccaaagaccagtcattggcggtctaaggccacttatgctccggtttctaagcgcgccagtttacgctcttaaagtttcaccgggaagaagaatcccataatcatcgcgccaataatcgcaccgcctgggattggttttttccaagcgtagaacaacgctgcgccgaccgtgctgccaatgccaatcggaatgctggcagtcacggcactgagaataatcagcggcccaaggaagcggcccgtttggttaccggctcccatcataacgtcggcaccaaatgtcgcattgctttggttaatcgtgaacttccgcaccaggaaaatgatcatcccgatgattaagcccaaaatcgccccagttaacaacgccaaggcaaagtttgacaccagcgacttggcgccaaccgacagtaagatcgccggaatcccgatcccgacccctgtcaaaatcgaaccgccaagatccagaatgccgacaagtgacccttccagaatccgggcaaacaggaaacttgccccaaacgccgccgctgcgccatatgagccaccggtcatgccggctttcaacatggccacaatcgccacttcattgaaggccccaacgccataattaaaatacatggatgttccggcaaaaacgcctgccgacatcattgcaacaatcgcgacaaaaccccaatccgcatgccagaaatcacgatctgcggcttctctcaattcttcttcaattggtgcttgatttgctacagcttgtttatccgccatcagtcaatccacctctactttccgcttaacgtgttatgaatattcgacaaccagtcaggtgcatttaagttaaaggacttcagcaagttgagatcgaatccgcggaagaaccctgataagacgaagagcaaaatggccgcaaccaaaattgatttcgtaattcgagtccatcctagttcatcaacacctttaccgacaagaatgcctaaaaccacccctggtaccgcattacccataatcatggccgacaaaccaccaaacacggttccaaacaggcctgaccgtcgaccggcatcaattgccgccaaccagaataagattggcatgacaaggttaatcaactgattcgccgccggaacaagcactttaaccgccgtcacttgcagcgattcgggaatcgaactggacgtgacattcaagaaagcaacgaccacgataccggcaatcgccccggcaatccccattttcttaggattatgcatggtttgttcaacgttacgatttttaaccagtaacccagcagccgcccagttcggaatgacacggtgcgtaatatcctgcgtaaaggcgccggccccaaccgttgacgcccaggcattgaagaagaagcccaacccgaaactaaaatgcgaagccggatcgccttctgccgcgttcatttcgcccagtgttcgaaacgcgcccaaagcttgtgtctttggcgcggtgaacatccgtgctgccccaacccctgccgcaaaaccaaccaatccgccaataatgatggactggaataaaattgtgagaattggcaattcatttcacacccttcaaaatattctttagattcggcaatgacatggcatccggcgatggtgccgcgacgtcttcaaaaaccaaagcgtcaaggtcaatcgccgtaactgcaactgtcactgccagtgtcactgcataagtggtacgcgtgcgtttaaaaaagaaaaacagaaacttttccgtataactcgacttaaccagtttcagcggctcgactttttcgggaacgatccgcaaaatcgcagtttcggtatcaccaatcagctgtttttggatattgctaaaagcggctgcaaaggcttgctgcttggtttcacctttgccagataccgtgacgacttgatgtttggtttcattgacgactgtcatttataaccgcactccttacgcttcgggatacttcttgttccacgcttcgaccagtgctttacccaacgcttcttgatccataaagccaaaaccgagaactttagtgccttcctcgatggcagtcacaccttcttgaatcgagcgcatgccatgacgttccggccatccatattgcgtatgcgcggtaatcgcccccgcaccaccggaaccacagaagctaatgcccatatcggctttttctttatccatcacctgacccaaacgcatatccgcccccataccaggcaccacaacggcagtaccaccagcggcttcaacccctttagcaacgttttgacccttacccatccgatctgcgataactactttaaccatgatatcttcctcctgagcgtgaactggcgcggttagaatcttcgccagttaacacgagataattgcaatcgtaaaatatctccacttcaaatcttgttctgcgccgcttcaaagtgaatcgataacacatacttctccgcatccgccaaatgaccgatgcgccgaaccacttgatcggctaaatccagcgactttttcgagacttccgcaaacatttggggatcgactgccggcaactgttcgcctgactttgagcggttgatcatttcaatcagatgattcgttaacacttgcaactgaaccgcggtaaaatgaatatccgcttgttcggctaactgaatcacgtcactgacaatcacttgaaccgcctgtggatcttggctttgggcaatcattttttgcacttcaacaggtagcttaatttcggcttccagtggtgacatcccccttctgagacacagcatgacctaaattcaaatattcaagaatcgcatggatttccgcgcgattgatggcaaggccatgatcggtaaaaattcgttccacggtgccagctaatttggcatcgtcatgattaggttttccttggtactgcttgccaaacataatgcgctgggcagctaaaaagacgtgcatcatgaacgcatcggcataatacgggtcaatcttggttggcaactggcgcttgagttctgaataaagactgaacatggtcagaatggtttgttgcgtctgcttttccagatcaggcttaggcttaatcgggactaccggcggctctgctttgagttgttcaagtgacacctgcaagcgtttggccaccgcacgtcggatagcggcaatatcagtcgcgtttggcaacggttggacttcaatgacttgcacatccagatgcttcagtgggaaaacgctaatcaccagctcaggatgctcgcgggcaatcagcgcccgtgcatcatcaatggaggcaaatccgaccaattcaatgttgggtatcgccgaagccacgcgctgttgaatcagattggtgatcccaataccggtggcacaaatataagcgacccgcaccgttttcagttggctgtcccgattgagcgataccatgaaatgcaaggcgataaaggccacaaatgcatcgttcaaaatcgggcgataggcggccagctccttatgcaccgtcttttcaattgctgcaaacaactgcggatattcgtgcttgatgtcctgcgtaaacggactgtattgaagcagttgattctccttgccaagcgactggctgaggtgcaggtagagattttcctgaagttgactgtcgtgactgaaatcgtgatcaaccagcgccccaactgccaggataattcggtgcgtcatagccacaaagttgtcgttctgtgccaccgttaacttctgaccatctgctccaaggtaataagcaaagtcgtcggcccaaactggcaagttgtaaaacgccagtgctttgagaatcaactgcccggtaaacgtggtgctgtcgccttgctccacaatccgatgataactattcaccggctgattaatcccttggcgcacaatgccgattgcaagccgaatcatggtcgtgatcaaagcgctgggatcaggcattttctgatcctgttttcccagttgaatcgccgctttcaggatcgtattaaacgcatgatcaaaggtcggctcactcgtcaaaacgagcgcccgtttcggttcaaccaaggcattgaggcaatccaccagctccgccatcaacgtcttacgattcaactgctgagcgataatgcgttccagcaaccggcgaatatccagctccgtccccgtgagtttgtagccataataattcttactcgtgagcttcacattcacttgatgcaaaaaggctgccagtttctttaaatcgttattcaccgttgtttgactgacattcacccgcgcttgaagctgctgttgcgtcgtatagtcacctgtttgcgccaaaatcagaatcatgcggataatccgttcattcggggccaaatagttatccgccaactgctcatcgattttctcgcgcagtgccatgcgatcttcaacgcttgcttcaatccagacgccttttcgtggtgcgctttcgagtttggaatggtgcaacgcaagccattcacgaatatctgccaagtcatacttcacggtgcgaatactgaccgccacggcttctgccaactgcttagatgtcaccaccccttcagcattcaataactgcaacacaatttgccgctgccgagtactcaattgcaacgtgttcaccccctcgtaaaaccacttgccacaacgatgccagacgcctgccagcacgccattcacaccgtccatttccaacctccaccgtcactttaaagcgctttctaaaaagaaacaatacgcaatcattgcacgattaatcgtgcaatcgcatgtgatcgggcaaacaatggcaaaatggtctgttccaattataacgaagactgtattcatgccgctaactttcacccttataaaaatgcttatgtatagggattaaaatgataagtaaacgctgactatgcctgtattgatatggaacaatcgcccagacaggttcagacacttttcacattattaagaacttaatcatgcaaaaatatgtttctcacaccctcaaatacaactgttatctgattttgaatttataaaccacatcaagtttttgaatgcttcacataaaataataaatagttaggtggcacatccacaaaaccccataacttacctcatcgtcactaatcgcagcggcttgcgttcatcaaaaaagcctcctgttgctcaactttcggcaacaagaggcatctttattttgctagtgctttttctcttaaactcccgcggtcctatcaagctggcgtccttcttcattgaacacccgaatcgcatcgttagcagctgcgtttgtcattagctgtttaaagatatcataactgatcgtcacattagcagcgccggctttgatcgcggccatgacttgtgaggcgtttttgaaacttgcccccatgatcttaatatgcgtatcggtactttgataaaagctgtgggtctcggcgatcattttatatggatcaatgtcgagctgctccatgcgattcacgtatggcgcgatatagtcgcaatccacaacgcaagccatgaagccttggcgcgttgaatatacggccgttcccagcagacattcatcgggctttttatccctaattgcagagattgcctgatagcccggttcaaacagcggcactttaaacgccattcgggtatcatccgtgtccggaaaacggcggcgcaattcatgataatcagccaacagttcgtccttggtatcacccaccagctgaacgaataaaacgccgggctttaaggcgcgaatcttagtcagctgttcaaaacgcggctggccttccttaagcaacaacttaggattagtcgtaacgccttcaaactggttaaactgcaacatttccttaatctggctgagattagcagtatcaatgaacatcgcttattcccccttcataaccttaatgacggtgccgacatccaaatccggatagggctttttctccaagtacagtgatccggccagttccggtgtggtcgcaccgtcaaaaacaatcgcggtgtggcctaaattgcctaagttcgtattgacttcgttgcccaccgccgtaatggcataagtctgatcaccaaacatcatcacatcgccgggcttaatcggctcaagaatttgattcactttgataatgaagcaggatgatcgcaacgcgtcaggcgcctcatctccaaaaagaatcgccatgttaatatccttaaacccgcgcgcttcggaaccaacttcaagaatggtggtttcatatttcactgttgctactgacgacaccgcactcacctctctaaaaatcctgctttattttgcatacaaaccaaaacttgccaaccaagcgactacgactcggggtaccccgtttaagaaccgcgaatacaacactgaaaccacgccgacttcaacggtttttgagtctgcttcttcaagccctaaaccaacaggaatgaagtcagccgcattttgcgtattaatggcaaacagtgccggtaatgcatattgcggttgaatgttaccacggccgatttcaaccccgatcagcgtcccgatgacttgggcaataaccgcgcctggaccgagaattggggataagaatggcaaggaacagataaaaccaatcgcaattaagccaaaaacattcccagccagtggcgtcatgagtttggcaaaccaactgcctaaacctgagccctgaataatcccgattagcaacgcgacaaaggccataaacggaattacggtgttaagcatggtctggacagaatcttttgccgcttggttaaaagtcgcaattaccttcccggcaccaattccgattcgagcaataaagttaggctttttcatttgggcagtgatcgttttgttcgtgtcaaacttggcttcgcgagcttcagcagcttgctcgtcggctgctgctgtttgcttttctgtggtcgttgttgccgccgaccctgcttctgccaaggcagcatgctgcttgccggcttcaccgcgctggtcaaatggaacgccatttaacgcctgatccggaacagcatcatccggcaatgcggtaatctgattcacatcaacattggaaacatacaatttaggcacaatatattttgccagtggtccggattttccggtgggcaacacattgatggttaagatatttttcttcggataaatcccacagcgcagcgttccgccacagtcaatgatcgccaatgccgtttcgtcttcaggaatggatgttttaaatccatcgacggcttccattccggtcaattccgcaattttgtccacgatggccggccggttaccgcctgtcacgtagataaacttatgcttctgttcggtcggtgtaattgtcaacggcccgccatagccgcctgatcctttaacgacttgaatgctatgccattttttctcagccatgatcctaatctcctcattttaaaatcacttcaacttcacgctatgaccgctgctaaacttcttggccgttacgtgcagacagatcaacggttttgctcagagtaatgccagtttgcttggaaacataagcagttgtgaagtcggtaatccagccaccgataaagttcatgacaatcccgactaacatatagcgaatagccagatccatttgattcagtccgagtttttgcaccccttgcgcaatccccaaccagacaaacagttcacctggattgatatgcgggaagacgccattactcgtatgacaaaactgggcttgagcggcataataactaggcttgtagtattcaggcaggaaccgagccaacgtgaaacacattggattgcccagcatgaacgccgcaagaaaaggtaaaaccagataacgcattaacacattacgacttgctttttgggcaaaccgttcgatgcgttcttccccgataaaggcaataatcgtattcatcagtaccaacaacagcagcacaaccggcacaatgttggtcatccagctaataaacgtcttgccgccagtttgaaacagcttcataaagccagcggcaaagtcagaaatgtattgcatgatggcatccccttagatcgtattttttctaaaaacatgcgccaatgcatcaggcaatgctttgatgcgctgaccgatctcattaaaaatcggcagtgcaaacatgctgacgcggctcgtatcaaaatcttcgaaactaagattattcgttttataattcacataattacggtaagcattcagaaaacactcacgctcggtccgactcagcttctgcagggccgtataatcagcgccgacttcagcgactaactcaccatcaaattgagcaacttcgcgaaaccggctaaaaacgctcaaccctttcatcacccgaatttcctgaatccgatcatcgtgatccaacccaatcaacatcagactgccttgccgaaaacgccgcggattcttaccgattaagacgcggccttcctgacgaactgcatgataattgcgggcaaaattacgaatttgaaaatagcccattaacgcctgcaataaaaaggcggcagccacaaaaatacctagtatcaaaatgttcattcataatccctccgttacaatggttaacggatcgcgactgtctgtaattttctgaagattagccatcgccgtttcattcaccgccagcaaaaacagcaaatcatacaacatggataagtcctccaacgcttttttgcctaaggtccgcggaatcccgatgacaaaaatataactaacggacttgccgccaatcgtgatggcatgtgtcaacacactcagatgcagaaacaagcgattctgatcaatatcggcaatcgcatggggaatcgccgcgccattatcaagcacaaacttggtggtggcttcatgttgaatgagccgctcgataaaaccggcatcgaccaatcctgcctggcaatctgcctgaagcgtcgcgcgcaaaacagcttcatacgattgccccgggtgattgtcatagatttgcgcccgccagataatgcggccagcatcaatttcatgttgcacagccgaggcgcgcaccttcgtctcaagcacccgatcccgaaaaatgtcgccaatcatgaccacgggaactttcaatctgaatgccaatggccggtctgtaaaaaccatgatgagttgatcctgatgggcaagaatatcggtctcatcctgaaaagtccgaatgctgacttgcgattcaaacatggtgttcaattgactttgcaaatattgcaacacgctttgccccatgcttgaaaagaatccaacttgcggctgatccagcgacgcccgatccgcatgttgcagcgccatttcgaagtaaacggtcaaataattaatctcaacatccgcaatgtgaatccctaaaatttcttccagcttatcaatcatcaccatcgccatatcggccgctaactgaaaccgctgaagcatcttatcggttaaataatccgatggcgaaatatgaaaaatgccgcgattgatcagaaaaatcaaatgatacttcgtcgtttgataaaactgatcataatcaattttggcatcaaccaaggtccgaatgtcagccgcaattcgatcgaaaatgactttgtttgcctgtaccttttgggctaacttttctgctgataataatttatttgcatacaggttaaacggaaacgccaaaaagttatattcttcctgattgaacttgacccgacaccgatcctcaatgtccgcaatgatgttaatgaacaaaggtgaatcttccattaagttcgtgtaatacttgctgatgccgttaagttcatagtgatgacgcttcaggaaaacgacaatttgcatcaccttttggaagatctgggtggtactcgttttgatcttggccgcattgagtcggctaatcaccgccgcgactaaagtcttatcgtcaaaaagccttgcctgtacatagtcgaataagtggttataaatcagcatcgttaaatcgaccgttgagcccacctgcagcttaatgccgcgactcgttgcactttcaatgccaagatcgtaattttttaaccagtgccgacacgcgtctaaatcttttagaagtgtgccacgactcacggtcagctggtcggcaatctcgtccatgggtacaaatttccgttctttgatcaaccgaaacagaatctccgcctgccgtttttgcttgtcgttattatcaatgttttgcttgaacacgcctgactgaatcagtgaaaattttcgataattcagaatatgcaggaagtacccgcttttgttaatgcgaatttcggctgcatcccccaacgactcgcctagttcatggatatatttttgcatcgtgcgtgtcgaaacattctcgctttcagccaatttgtccaggctggaggtaccatttgccaaaagataacgcaaaagccgataatccaaactattcaatcaggtgacctcctccaaattaccgattagccgcgcgatttgcctcctgccacatttgttgtaacgcccgtgatataacttgctcgattcgataagaagtagttcaccaaatccgctacttcactgagtttcccactgcgacccaatggcgtagtcgaagtcgaacgataaccggcgcgaatggcgtcaaccgtggtatcgcgcgtatatgccaaggcttcttcatagctcggtgtccgcaagccggttgcttccataatccccggggcaaccccgaccacgcgaatgttgtatttacccaactctttagcccatgaacgcgtaaacccattaatcgcgcctttacttgccgaataaacactttgaccaacagagccttccaaaccggcttcagaagacatattgaccacgacaccgtggccttgcttcaccattcgccgcaccactgcctgagaaaccaagaacacgcttttgacattaacactgaaaatctgctcaaacgttggcacgttcagttcatacttgccatgcggatctttggggtcaaccaaaatccgcggtttattgatgcctgcattgttgacaacgccccagatttcaccgtttattttttcggccgtagcagctagattttcaaccgcttccggatccgtgacatcggtatgaacgtaagtcagcttcggatctttcaagtcgccttccttcagatcgccgttaactacattggcaccgttatgaataagttctttaacaatcgcggccccaattcctgatgagccacccgttacaacaatcgtcttaccatctaagcctaaccaatcagacatatgctatcgctccttttcatctttcgtttttatggtagcgttttctttggctaggcttaatccagtgattttccatcgaccctgaaaattcgtgaaccatgtcgtttagtttcaggattataaaaaagcagatggatctttcgtaacttacgaaagatccatctgctattgttttcttgtgttgttccacgtttatctataaacttggttatcagaataatataacaaaattgccttcacccaacactcacgcttttgtcgcatggctcattgactttgctccgtcctgaccgtaatacgcattggccccatgcttccgataataatgtttatccaataaatactgcggcaagtgcacatcctgatgcgtcaaagtcaatgcatgataatccatttcggcgatcacttccaaaactttggcattataaaccgccttcgcaggagtcgcgccccagctgaatggcccatgctggctgactaaaacagcggggactgcgttatgatcaatgccgcgatccttgaaagttttgacgataaccttgcctgtattttcctcgtaagcttcttcaatctcttgttgggtcaaggcttccgaaatgggaacatcaccataaaacgtatccgccgcagtggtattcaaattcggaatatccatgtgcgccgaagcaaatgcaacggcccacggtgaatgggtatggacaattccgccaatgtcaggaaaggcattgtacaaaacggtgtgggttggcgtgtcgcttgaaggattcaactggccttcgacaacttcgccttggagattcaccaccaccatgtcatcaggcgttaagtcctcgtaatcgaccccggaaggcttgatgacaaacaggccttgctcgcggtcaattcctgagacgttcccccaagtaaaggtaaccagatccaactttggtaactgcatattagcggcataaacttcttgcttcaatttttctaacattgttaaaacaccccttctcaattcatcaaccgcgttactgtgatacagcgcggtccgatttaacatgtcgctttaggcaccaccgcttaaaagtaacgataggttttcatttgcaaaatctatgaaagcggttttaaaggcaaaaactctgatataatgggacataaccacgtaaagtcggaaaggaagtttacttatgctcaaagccattgcacttgatatggacaacacgttactgaacagcaataaagaaatcagtgtcaccaatcgcgacgtgcttcgttacctgaatcgcaaaggcattcgcattattctttgttcggggcgcccttttgccacgctgaagcccttcttggacgaattgcatgtgaccaaaaatgatgatgtgtgcgtctgcttcaacggcggtttggttcgcctagttcgtgatcacaccgtcattaaggcaaacaccttgagcaaggaacagatcaagccggtgtatgacctcgttaaggaaaacgggtttaagctcgatattgttgccgaagatgaagtgtattcactcaccgaatttggtaaatcaagctatcagacgatgattcctaagcagatgccgtttatcgataccacgttcagtaaagtgccggccaagcttccgattttcaaagtcgtggttgcaggcgagcctgctatgattgatgccgcatcagacgctgcccagtcactcaagcagctgaccgtcacgcgatcccggcgcacactacttgaaatcctgccgccaaatgtcaataagatgaacggtttaaaagccgcactcaacttttaccgcatcccgcgcgaacaactggccgcatttggcgatgaggaaaatgacaaagacatgctagagtatgccggcatcggggtggccatgggtaacgcgattcctgaaatcaaacaaattgcggacattaccgtgggctcaaatgatgatgacggggttgccaactatttaatcgattacttccagatcagccccactgccattcgcctatagttaaatgaatcgtctaaagccggcaagcaattggcggcttttttcgtgtgcaggtcagcaggcgcttcatgatgggacattggtttttgccactggctcctgaacaaaaccagcctgcacaaacagcggatcgaaaaagtccttggcctgcttcacttcttggatcggatcggcggccttttccgtccacatctcgatcgtaaaggcgccgctgtaatcaaggcgtttgagcgtacgcaggcagccggcaaagtccaccacgccagcgccaaacgggacatcgcggaattgccctttgctttttaccgtcaccgcttgggtatccttcaaatgaaccgagacgatgtttgcaattcccagttcaagctcgcgaccgacattgttttccggccaggctgacaagttgccaagatccggatacgcctgcaaccacggactcggaatctcatctttaatcgtcttaatcttggaaagtgaattcaaaaacggatcgtccatcgtctcaattgccagcatcacttctttagccgcggcataggccacaccgcgcttcaggttctcgataaaatattctcgtgaagctaaggttttcggctcatagtagacgtcataaccggctagttgaacattgcgaacgcccagatcactagccaaatcaatcgccttacataacatcgtcagacttttttcacggatcgccgggtctgccgagcctaatggaaaccgacgatggccgcttaacattaaggtatggatccgcacccctgtttgccaacaagcatcacgcaccttcgcccgttttgctgccgtccaatccaaccgggccaaccgttcgtcactttcatcaaccgataactccaaaaagttgaaacccaaatcccggaccattttcaaccgttcaacccaagattcggtcctgggcagtgctttttcgtaaattcctagtgaaatcacaaatattccctccttgtgagcgcgagccggcgcgcttagaagtcggcgtgtaagcggcctcagacgtgatgacccgggcttggtcattgcgactggggtccttacacgcaggcttctgcgccggggagcgcgttatggtgagctgagcgcgagccggcgcacttagcatcaaactgcctatatcgcccactcatcccctatttttggcaacaaaaagctggcgggcgccttttgtccatgaccgatcaaccgaattgttaggctggatcggctaagctaagggccttcgccagcttgctgtttctgaatagttaattagcaacctgcacaacatcaattccttgacggcgcaagtcacgcactgctttttcattggcaaaattatccgtgatcaacacatcgaccgcagccaaatccgcaacatgataattgctggtaaccccgaccttgcgataatcagccacgcaaattactttctgtttcgtccgcctgatcatggtggcattcacctgagcctcaaaaatattctgtgtcgtgacgccgcctttttcactgataccatcgcagccgatcaacgtgaaatccgactgcatcgtctcaagaatctgaaccgcaaccgtccccaccaacgactctttagggtagcgaatttcgccaccagtcaagataattgaagtttccggatggcggacacattcggtggctcggatattattggtgatgatcgtcaaaggcatcgttgccaattgattaatcgcccgccagcacagcgaactggaattcacgaataacgtactgtttttgacaatatagctcgggaccgcagccgcaatcgtatccttcaacagttcaatgccggaacgcgaggcatgattggcaggcgttgcaacgttagccttttcaaccagcccgtgatgccagtgaacctgccccatttctgccaaggctttcaagtcgcggcgcaaagtggtaatcgaaacgtcaaactgccgggccaattgttctaccaccaccggctcgccttgatccaccgcttttaggatcttctctcgccgtgcttgaacattcaccatcgagtttttcaccatcatcacctcataaacctagaccgccgcgcttagaagctaacgaacgcgtcatcataaaaatcaattcgtcttatttaccccagatgcgaataatttcattctggaaatctgtggccgctttggctggatcaggtgcctgagtgatcgcccggcctgcaatgaacgtataaacatcgacacctgcaaataacttcaatgtgtccacgctcaagccaccggttacggaaacccgaaagcccatatctaccaacatcttcaccttagcaagatccttttcaccccatgagcccccggaaagcaaggcatcgcggctttggtgataaattgcctgggtaacgccaatgtccaaccaggattgagcatcttctttggtccagttgccatataattcgatctgaatttctttaacctgcttctgggccgcctgaatcgttggaattgttgcggaacagatacacgtcatccaatcagcacctgcatccgccatattcttggctacggtagatccggcatcggcacattttgtatcggcaatcaccactttatccgggaacaacgcccgcaacgcacgtaccgcaatcgttccttcctgcaagatcaaaatggtgcccgcttccacaatgtcgacaatgttgccaactgcgcgaatatcgcctaacgcactttccaaagtgttgttatccaaagccacctgtaaatttggtttagccaaaatcgttcctccttgtctgccatattgctatgactgttctgttaacgtgatgattgataagacgccagctcacggccgactcgcgcctgtcataacgcgttcgcccgcgcagaagtctgcgtgtaaggacctcagccgcaatgaccaaacccgggccatcacgtctgaggccacttacactccgacttctaaccgcgctggctcacgctcagctttccataacgcgctccccggcgcagggatctgcatgtaaggaccttggtcgcaatggccaaacccgggccatcacgtccaaggccacttacactccgatccctaaccgcgccggctcgcgctcactatttcaccaaatccgtatcttcacgcactcgttgttcaacttctttatcactcatcacattcttaacgccaatcacctgaacgcctttttccttggcatctttgaacatgtcgacaaagtttgtggtggtgaagaccatgtcatattgtttagccgtgcttttaccttctgccaagttggtgtgttcaatttgggtaattggcagattcaaccgcttaaaggctttctgcacactacgcatcatcatcagactggtccctgaaccatttgcacacgatactaagattttcatgatatttttcctccatattttgcgttagcttggtctcattcactttttacgtcgagacccgagttgaaaagactactgagcttcttttttctttgcgacattttccttatattgctcataatcggtgaccattaagaagtagtttttcggatcatgccgatattcgagttggggaatcaagacgaggattaagacaaccaccacgatgccggcaatgcccaagatcttcatcaagacagtgaagaatggccatacggtatcccagtcgaacatgccgaggtagccgccaaacttcgataacccgatccaggtggcaatgagcgctgcgccgaagacttggatcagaccgctgaagaatggcaggatcatcgccgcctttgccccggctcgccggttagcaaagaccccaaaggctgcattatcaaagaagagcgggataaagccggcaatgataatcgttggcgaatggaacaggagcaaggcgccgattgcgagaaactggcctaatgccccaaacaggaacccgattgtgacggcgttgggttcgccaaatgcgaaggtcgcagccacgtcaatccccggaaccgaacctggcaacagccggtcggaaatgccggtaaagctttccgtcagttcaccgacgaaggtccgaaccccgagttgcagaatcgtgaggttaaccgcaaatccaagtgatgtggtcatgatataaaacaggaaactgccatttggcgccaaaccagaggccccttttgaagccgtaaacacgccgataaaataatcccgaccaagaattaacataatgatgccgaagaaaaatagcattagaattccggtagcgaccatgttttcattgaagatcttgaggaagccgggtagttcaatgtcttccagccgccgtgcctttttcttggccttcacttcatgcgccttaaacttgtctgccagccacgatacgaaggcaatcccaaacatttgttgatgcgcgactgcaaacccgccgccatcggtcaaatcctgggtataacgcacggtcatgttcgaaccaactgcccagtaaagtcccaagacaacgcccatcacgagtaaaacttcgatccggcccatttgcgggaagcaaaacagcagaatccaaaacgccgtggctgcttgttgcacctgcacattacctgtcgtaaacaccgcgcgcagtttcgtccatttctggaaccgtaccagtaaaatattgaaaacaaacgcaaacaatagtaacaacatgacatcgccaaaagttcgaccaaatgtcttgtctaacccttccgtcacggcgttttgcccgaagtatgggtcaatcaccgttgccgttaagttgaaccgatcttttaacccggtcagaattggtcggaagctgttgaccaagccgccagacccaaccattaagatcatgtagccaatcaccgctttaaggaaaccggcgatggattcgtataatggcttacgttccaagatgtacccgagtaagacgataaacccgatcatgtaagcaggttgcgtcaaaatatttgccgcaaaataatcccatacgctcactaagaaatctagaatttgctgcatgatgtgctacctttccccttcagctccccgcgtcaacaatcgccttaaaatcatcaacgctattgacggccaacagttggtcaatcaatccttccgtcattaacaagtcggaaagatccccaatattttgcaagtgctgctctggatcctttgctgctaacgtaaagaacaattgcgcctgtttttccggatcagctggatcgaaaacaactggcgccgggaatttggcaaacccaatcgccgtccccaaaacattttcgctttctgccatcgcatgcggcatcgcaacgccgggcacaatcacgatatatgggccgttcttctcaacattgccgataatttcatctacataacccggcaaaatgtattgatgctcaatcagtttaccggctgcttgttgcaaggcatcgtgccaatcttttaccggttcgggccgaatatcgaccaaatccttgtccaaaaagtctttcagtaacattgttgatccccacctcacctgttttatagaaatgccgggaatggcgtatcatttggtaccgagaatgtatcgtggaagccgcggtcatacatgaattccatccgatccttgtcatctggaaaagtgaattcaccgccgacttgccagataaacggcttgaacttgtattgcagccggtctttccgcattttccatagcgcttcgatttccttcgggtcagccataaagtttgtccagatatcgtaatgaaccggaataacgacttttgtcttcagtgattcagccatgcgtaaaatatcgattgaagttactttgtcggtaatgccacgaggattttcgccgtatgcccctaacgcaacgtcaattttgttttcgttaccatgcttggcaaataggttggagtaatgcgaatctgcggcgtggtataaattcccgcccgtggtttcaaacagatagttgacggcaatcttgttcatatcctgtggcagtttacccgcaaggtgaacattcggatcgtcttcggtcactaatgcggtccgatcaaaactttcaagcactttgaccttggtttcgccaattgtcacaacatcccccggtttgacaaccaccgtcttttcagccggaacgccccagccttgccaaatttcacaaactttttccggcccatagaattttgcatccgggcaattggcattaactgctgcagcggtgttgatgtcgagatgatcgctatgaatatgactcacaaacagcgcatccacattcttaatggcaaatgggtcaatcacaaatggctggttgcgcaggtttggctgcatctgctgcaccccgctcatccgcatcatttggtgacctttgcgcatcatcccgctaccatgcgaccgcttaccagtgccgcaccacatatcaactaaaatgttggttgcttctgccgtcttcaaccagatgccggtacatcccagccaccacattgaaaaagtccctgctttgacctgtttatccgcgatttcttcattcaaccaagtaccccattctggaaaagtgttaagaatccagtcttcgcgcgtcacgttattgatcgtcttatctgccatgatgttcctccttaaattcgtttcccgatttcactttttatgttatggaatattgattgcgcttacaacactgctatatgcaccttttgcggattatatgaccttttatgaactttatatgcatcttagcaaagacgatcggcttatttttatgaatcaaatcatattccgtattggataaatacataaaatacatgttgaaataactgccaacctaaaaaacgagccagaattctcgttggaaaaatttgcgaccatgtctgtaaaaagcatcacaatttagttaaacctgatttaatctataaaccttatcttcagaaattgtctaatcagtaccaccatccttcgtgcataaatttatccacttttactagtagatttattaaacgctatttgaatttaaattaaacaaattattcggcaaaatagggcgcgaaccgtttctgaatattttgacgattctttaagatttcattactttcgccaccacccaaaagcgcgtatgttgctcggaaaccgtctatcaatcaagtaaaatatgcgtcagttatatcaactcatttttgcttcactattttgggatacctaacttttatttacctatcgcattggttctgattggcagcaatgaaatgccaacaagaaaacgctactttagccgccactatcggaaaagctttcactgaccaaaattttcatttgacgcttgacacaggcgtcagggggttataagcttgcggttattaagaagaaatgagattattttgtctaaaatgtgatttctttgggtattttggtgttttattttcagattcattttttcttaataccatttaagagggggacgggcgtttatgaacaagaatgcgacgaccgaagcgaaacgtcactataagatgtacaaggccggatctagatggatgacggctgccattatcacatttgggacgagtttagttgttttaggcggtactgccacccagtcggtttcagctgataccaagacaccgactgcagacaaaacgacgcaacctgtcaaccaatctcagacgcagacggcgacatcaacggcaagtagtcaagcgaccactgctgatgccaaggataagacagctgagacacaaccaacaaccaccaccacgactaagcaagtaaccgcgcagtcgcaggccgcaccatcgacagctaccaaggctcaatcacaggcaagcacaacgaaccaggcgcaaccggcagcggcaactaaagttcaaaccggtacgccgtcatctggtgccaacacgcaaccagccgccaacaccgccacaaccaagagtgcaacatccacgacatcatctgccgcgacacaatcggctgcaccggctagcaatgctgcaaccacgaacgccgccaagacccaatctacggccgcaaccacaaccgatccaggaccggccaaccaagacactttgactaaaggtaacgtcaaaggtttatggaatgaaggctatcaaggccagggaatggttgtcgcagtcattgattcaggggttcaggctcacgacgacttgcgcctcagtgatgacagcaccgccgccatcaccaaagaaaaagccgaagctgccatttccaagttaggctatggctcgtacgtcaacagtaagattccatttgcttacgattacgtcaataacgacagcgtcaacaccgggaccacggtggctggctctacccacggcgaacacgttgccggtatcatcgcggctaacggcacgaccgctgacggcgcaaccggcaatgaaaaagccaccacttacgtaaaaggagtggctcctgaagcacaaattcttgcgatgcaggtcatcgatgaattcgcggatgaaaatgctaatgatatttcgcgcgcaattcgcgatgccgtaacgctcggtgccaacgcaattcaaatgtcactaggcatcggcgttaccgagcaggatctcactgacgaagaacaagcagccgtgcagtatgccactgatcacggtgttttcgtctccatttccgctgggaacaatgccaacgcaggcagcattatcggttccaaaacgtccaatgatatctccacggcttactcgcccaaaaatgattcaaccatcggcgatccaggagcggcggcttctgcaatgacggtcgcagccgaaaagagtgcaaccggtgacaaatcagaaatggacggcttttcatcatgggggccaatggcggactacaccttgaaaccggatatttccgcgcctggtgataacgtcatttccacggcgattgatccaacgaccaatacccaaacctatgccactgaatcaggaacttccatggctggtccttacaatgccggcgcggctttacttgtgatgcaaaaaatcaaagcaactcggcctgatctgcaaggagccgaccttgtcaaagcggtcaaactcgcgctcatgaatgccgccgatccaatgaaggatatcaattatcctgatacttacatctctcctcgacgtcaaggtgctggtcaaatcgacgtctctaaagccggcgatctaaccgttagcgctgaaggcaacaaagacgccggttcggtttcgctaggcaaaattggtcaaaccacaagcttcaccgtgacactgaccaaccatggtaagaccgcgcaaaattacgttgtcgataccaacggcggtccgctcacgcaagttcaagacaccagcaatggcaacaccgtccacgatcagaccctcatcggcgcaactgtgaatacggacacagccaacttcacgcttgctgctggcgaaaccaagactgtcaccttcaagttatccctcgacaatactgtcgcggctaaccagcttgttgaaggcttcctcacctttaaggccggcgatacctcgcaaacgatcagcgtgccgtacttaggttactatggcgatctcaccacagaacaggtagttgatgcgtctgctaacagcggcgagtctatttttaatggcggctatttggttgatggcgccaacacaccactaggggtcaccgactcagcgtcactcagcagccttgtcaacactgatacaaccgggaagtatacttggacactggttccaacctacgtcgacaataaaaaggtttcattttcacccaacggcgatggcgccagcgacaccgtctatccatatgtattttccaagcagaacctcaaatccgttaccatccagattctagatgcacaaggccatgtggttcgcgtgttggataaggaaaacaacacgaccaagtcctacttgcaaaatggtaatacgtataactccgatcttggcttgagcacggatatgcgtctcgatccaaatgccttcacttgggatggcaaagtttacgaccaagcaaccggtaaatatgtcactgccccagacggcaaatatacttatcgtctggtgaccgaacaatacaacaccggcgctcagcaaaatcaggactttgatttaccggtcaccgtggatacggttgcaccgactttgacaggtctgagctatcaaaacggtcgcgtcaccgttaactacaatgatcaaggtgcgggcttcaccaagttcagtgacatcgcgttgaagatcggtggcaaagcttatggcgtcagtctgaacaacaacggccagaataacgatggtaccttgagctttgacctcaccgcagcccaaaaagctgcacttgaaagcagcgatggcagtttaactctgacgctaaccgatgtcgccggtaataaaaccagcaaaacgctgcaggcggtcaccggtacccaccaagcaacaacgccaacagcaacaaccgccaatgtggcaccgcagttcagctggaaagttggcgatggcccatacaaccactggcgcacagatggcttcgttcaagcggtatccgaccaaaccagctttacggcctatgcccaagttccagctggcgttgattggattgtctatgccaccgacgccatgactggtaaagtcttctccggtaaagttgacacgaagaccggcaatgtcacctttaacttaaccgcatccgctccatatggcgactttgtgggtaccgtcctcgcgccaacagctgattttggtacctatgaacaagccggccgcgctaacggagatgaaatggtcgtcttcctggatacagatggcaccgcgggatatggtcacttcagccagaaggatcctcacgtcgcggtaccgctgcaagataacgctaaagccgcggctaatgtgaaaacaaccagcggcgccccggtactgggtggtcgtgccttttctcaaatcaccacccacgcacaaccaacggaagggctgacgtttgataaattcaacgacaattccttcaccttggtcggcgccgataaagtagctgacatctacaatgccaaaacaggtcaattaaccatcaccggtcatgttgatcagccagccggcaagacgttaaccgtcaccagtgctaccgagcctgcgaagacggtcacgattggtgcagacggaaaattcagcttcaccgtgccattcaaagccgcagagcaacaagcaatcggctatcgattgacttcccctgccactgatggctccaaatcgacgcaaaccgcgtatggcgagctgcaaatctacctcgacaccattttcccaacactgaatatgccgcaagctgatacgttgcaggttgatgacaaaggcaattacgaaatcaccacaaccagcgacaccttcaccgtttccggaaccgttaacgacaacatcaatggctaccgtctctacacaaacggcgataacattgtgcaccagaagaatctagctgggttcaacaaccacctcgatccgctgtcaacgacttccaacccatacggtacggccgccttcacgcaaacctatcaattagcagacggcgacaattacttcaccatcaccgcggttgatatggtcggcaataaagtcaccaaggtcttccacgtgattaagaccaaggcaacaacgccaacgacgccagaaacaccgacgacgccaacgccgacgccaaaaccaggcacgggcgatcaaaccggcacggaaaatcctaaagggcctaccactactccgaaaacggatgagcaaggcaaaaccaatccgacaccaaaattcgttgatttgacaaacaccaccaagggccaagacaaaaccggtactactgctgaaactggcaagaacaccaaacaaaccgccgcagccaaaaccatgccgcaagctggtgaagcgcaaagtccactggctgttcttggccttgcaatcctaagcatgctcggcttggcaggattcgtatcacgtaaaaagcgcgtctaagccaatcaatcttggttaaggttgaataggaaaggaaggagttgagagtatgcagcccgtcaccattacaaatcttgatcggctcttaacggcgctgattcaagccaaacaacgcggtgacctggagcaaaccgttattgactgtctgccagtcgagcccggcgatgcccatattttcggcgtccgggcagacaacggtgaaatcaagtcactcatccacttccgctttgatcaacctttgccttccgattatgctgccgtactcaagcgtcatggatttcagcttactgttgagcattttaagcaagcgccatgagtgaatggcagcgcattgaggcgtagattcggttgggatgtgttttatctgtaaattaaaacaggcattgtaccagtgttttgggctggtataatgcctgtttttttgctttgcgagccttccaggattaggtgaaatgaaaataaaacgattgattttttacatacaaaccatttttgcatcatcaccgcgttacacttcttaacgcgccaccagcggcaccaccgccccaactaaattcgcatcgttgcgatacttagctgccacaatctccggaagcttaatcgtcctcgctgcaagtggcgttacttgcagataggtagcaacccgtgcccggatttcgtcgatgacacgtgattgaacgctaatcccgccgccgatgacgatcttttccaggtctagaacggtttgtatgttgtagatcatcgccgccacgccttgagtgaaggtggctaggattgcagcggcgggtgtgtcaggcttgagggttttaaagacgcgtgggccaagattgtggccgcgaatgtgttgggcagcagccatggcgttgacggttttgactgctgagagtccggcggcggtttgcgcacgggtgatggggttgaggccgttggtaatcatgaaactcggctcaccgctgacatcatggctgccggtatagagtgtcccgtttaaaaacagtgcggctcctaccccagtcccgagcacgatcatagcgctgttgatggtgccggcgagcttgccttgccaatgttcggctagggcagcagcattgccgtcattttcaatcacgactggtgtgtttaaatgagcagcatccttaagtcgcgcagccagtggcattgtttctagaaacgggagagcggcacaggttttgacgatgccttgctgctgattgacgacacccggcaaggccaacccgacgccagcaatttgtccttgatatcggtggatcagcatcgtcattgccgccataaattcagcccgactgttgcgcgcggtcggctgtttatgtttctccgcgagctcgccttgctccgatactaacgcatatttggtcgaggtgccgccgacgtcaattgccaagtactgcttcatggtaatcctttcttccacagtgcacgattgctacttaatcggcgccttgattcgtttttcatacgcatccagccatgcttgggtgactggcgtaatcgtggtcgtttgattcggaccgggatttgccatgaggatcaccggtttctggctggcagtggcgacgctgaaggtaaattccacattcgttgcgactccccaattgccggcgcggtctaaagcgatgagcgaaaattcaccggctttaccataacggcgctttaacttttcaataaacggataaaccgcttcatcgcaagcttcttgcggcgtacggccttcacccatgcggcgtacgatttcgtaggatagacagcctttcatgatatcttcgcctaacccggttgccgcggcgcccccgatgtcactgtcaacataaaaaccggatccggacagtggcgaatcgccaactcgacccgggcgtttcataaataagcctgatgttgaggttgccgcggccatcgatcctgttggtgccagcgtaatagcgcccaccgtgtcatggccatcgtaaggtttgattttggcgtcagcaagttctgcccggcgcttttcccaacgttttttggctcggtctgttaacatatttcgcatttcgaagccatttaactgggcgtactgggtggcaccttggccgacaaggaagctgttgtaatgatcatgactgagcgcgcgggcgaccgaaaccgcatggagtacttcatggatgccagcaactgcgccttgggccaaagtgtcgccatccatgaaggccgcatccatttcaacttcgccattttcattaggcaaaccgccatacccgaccgatttgtaataagggtatgcttcaacggttttgatcaatgcctccactgcatccccggctgtgccgtttgcttgcagcagctggctggctttcttcacgccatcgtgggccatgcgccaagtggcaatcacgccccaagctgtttcgttcatttatccatcgctcctaaccgaatcatcgcattcatatcaatcatcatatttaacttgagatcgtgctcatccatccactcgtccgccttatgcgcaatgcctttttgaccgggaaaagagggcccgaatgccacaatatttggcattttacgggcataagtcgccccagttgtggtgaccggttgaccctctcgccccgtcacctgttcataggcttgcgtcaatgctgccagccgcggatcgtttttgtcatgcaggatccccggcatgctgcgaatcacggttatttgggtgcggggaaaaacggctgcagtcagcgcgcgggtgacgtcatgctcttgataagtcacaggatagcggaccgccactcgcagactgatgaccgcgccgattttttgcagctgataaggtgtcacaatcaatcggccacttgcggcatcggcaaaatccatccctagcccttcgccgtggtgctggttcgccagcgtttgcaccaaccattggcaatagttggcaaactgtccgtggatcgcgtgttcgtctagcaattccttggctaaggttgtgatcgcatttttacctaactctggggcattgctgggcgcgcggatgccactggcagtatagcgcttgtcattgatcgttgcttgcaggtggtcaggcacatgatcgcttgcttggtcgccggtgatggtggctactttgtcgagagaatcatcggtgatgggcgtgcgcaggttaaaattcacaatgccgcgttcgccatatacaaccggaaatttgcagtctggcgtgaaaccaaactcaggcggggcttccttggcgagatacaaagggacatccgccgaaccgctttcttcatccgagcctaaaatcaaccgaatcgtccgcttaggctgaaaaccggcatccttgagcagcttcatcgcaaataaacaggcaatgcttgggcctttgttatcgagaattccccgcccatataagcggccagccttttccgaaaggtcgtatggtggaaaatgccaatccgtttcgcccgctggtaccacatccaagtgaccgacgatgccgatataatgctggtcatcgtcaccccactgaatatacgccattgccgaattaacaatccccgttttaaacccataagcctttcccagttctgccgcagcggttaaagccgcccgcgggccccggccaaacggtgcatcggcttgttgcgacccgcgaacacttttaatttgcatgatttggcgcaatgcttggataaaagtcatccgttgcgcctcatataaagctgctagcgtttcatttttcattcgcacttacttccttaaattcacacccgatcccgcgttaacgtggacttaaacgaatatttgtcagcgcgatagtacgaaatatcgtaaagaatcggcttggcatcggcagtataggtgacggaatggacgagtagtaacggatcgtcttttttcccgtggagtaatttgatcatgtctgggtcgatcagcacggcttcgacttcctgatgcgaataggcaatcggcacccgcttttcaattaaggcaaaaagcgagccctcaaagtcgtgtgcttgcaggccttcaatgtattcatggcaaattgcaacgtgctcaacggtcatcggttcttcatcccaaaaccgccgtcgcacgagcaggtcaacggttttgtttgcctgctgatcccgtcctagcacgcgcgcaatttcttccgggatcggatccagcgggccaaaactcagcacttcggtacgactcttcttgccatatgcgcgcgcggcttcggtaaagccttgtaaccccatgcggccgctttcgactttatcggtatacgacatgacataggtgcctttccccggtgacttcacaagtaattgctgccgaatcagtaggtcaatcgccttgcgcaccgtgagtcggctgactgcgaactccttagccaaatcatattcagatggtaagcgctggctggtagtgtacaccccgtcacgcacacggcggcttagttcatctgcgacctgttcaaattttgccattcgttttagcctccgttttctttaacaacgcttttcgtaggttcgttgacgttacgttcattttgtcatggttcatgggtgaagcagcggctgctttaaggccacttttgccgttcattcacatgcgacaattgcgcgcgctgctgcgattgtatgcccttccattttttgcttgtttttcacgtgctaccagtttatgcttagtatgcattgaatagtatatactacaagttttattttttgaagcgcctttttcccatgtatcatcgcgaaaaatccggtctgctaaattcactcgtcagtggtctttttacgcatctgcacgcaacctcgtcaaaaattaaataaaggaagtgtcatcatgctgtcatctgcccatgttcctgaagacaaacgctcgccgcttctagcgcttggcatcttatcgatctcattcttaatgtcggttagtaacgcggtttccggaactatcccgctgatggaaaaatatttttccgatgtttcgcgggccaacgttgaacttttaatcgtcatccctactggcggcgtcctactgggaacagtgattagcggtctggtttctaatctgctcgggaaaaagtatacggtcatcgccgggctgacgatttccatgatcttcggcatcatcccggcgtttattttcaactaccctgccattttaatttcccgggcaatgtttggcgtggggatgggggttttcacgccgctcagtgtgtcttacatcacggatctgttccctgaggagacgcggaatcgcctgctggggtggcgtaattcggttggcgcaattggtgatgccatcatgcttttcatcgccggcttcttgatcaacattagctggcacaccacttacctagtctttcttttcttattggtgccgattattttagtcatgtttctggttcctaagcgctacgactacatcgtctcggaaaatggtaaagaagtcgaagaaactgccaaggtgaagccgacaaccaacggcggcgttattcagctggccatcgtcttcctattcgtctgcttgttctactcggctatttcgttaaaactcgctagctacatggtggataatcacgtcggtagcgccgccgcagccacccatattttcggctttctggtattgtgttcgatcatttccggcattgcgtttgaaaaaatcgccaaatggtgcggcaagtataccgtagccattttcgatattgtgaccgcccttgcgatgatggcagtgccgtttgtccattcaattccagccttgttggtactggtgttggcggctggtttttgcaacgggatcatcaatccggccttaaccgcgcgcatggtccactactcgcctaaagggtccatgaacttcaccacttcgattatcatcatcggcatcaacatcggcttcctcatcgccccttactttttccagttcttcggcagcatcattggcaatgccgaccctgcaaccatgatcttgtggagcggtattttctatatcttgttagccgtttacgacttggtaatcgttaaaaaagaccgcttaagcatttgatcgcaaagattaggagccgctacttatgaacgacaatgttacttggtttaaacacgctaaatacggcatgatgattcactggggattatattcgctgctggcaggtgaatatcgcggtgagtcatcgagtgcctacgcagaatggattcagtccaaatttcaaataccaaatgtcgaatacggcaaacttgccaccgccttcaatccgctttactttgatgccgatcaaatcgtggctcttgccaaaaagtgcggtatgcagtacctggtcgtcaccaccaaacaccacgacggctttgccatgtatcattcagaggttgacagctacaacgtatacgacgccaccccgttccaccgcgatgtgattgccgaactagcccaagcctgtcatcaagcaggcctcaagttcggtctctattattcccaagacctcgattggcacgaaccggatggcggcggctacaaatcaaacgacctcgaaacagccggcaccacttgggacaacagctgggacttcccggacgaaacacagaaggattttgaccgctgcttcaatcgaaaaatactcccgcaaatcaaagaaatcatgaccaactatggtgacatcgccacagcctggttcgatgtcccgatgaccctatccgaagcccaaagccaaaccatttatgataccgtccgtgccttgcagcctaactgtctcatcaactcacgcttaggcaatggcaagtatgattttgtctcactcggcgacaacgaaatccccaaagacaaagctgccatgacccaaaccgatgtcgactataacgacatcaccggcttcaaaccgtcaccgctggggttatacgaaacagctggcaccatcaacgactcatggggcttttcctatcacgaccagaactggaaaaccccgcgcacactcttccgctacaaacaacaccttaacgattttggcatcaactatctgctcaatgtcgggcttgatccgctaggccgcgtgccgatgatggcagaggagaatttgctggcggctaaggcgttggaggatgaagctaggatttaggtttggtcgaccttaatgattgcttgatgcgaggttctgcgcatttcaaagtttaaaaacacctaaagtagaagataagccataattccggcttggtaaccatgactgatcagattccgaaccagtcaaaaatcgatgttgggagtaccgagccaaactcctcaatctccggcaagatggggtggcgactcgaagctagagctgtgatggcacttttaactcgcaaagaccgcgatttcaaagtctcctaacaataccagacgggttgtttccactgctgaaccccatctggcctacatttgctccgccttggcactaaaaccattaaagcccattcaaattaatgtaatgaatctaaaaggcgtactattttctcaatgagatgtcaaaaaatagtacgtctttattgtgtagatatgaattatgatccagcctcttcgtttgcattcccgccaagtggttcaggcattaaagatcctttaggcgtcatttattgatgtctgaatctcacacaggctgtgttgcgcgaaccaaattatcaagagatgctcatcttctgttgaaccgcagcattagcatccccataagtttaaaccaatcgtgaataagccgtaaaaaagcgatccactatacgaaaatagaatcgctttgctttacgccaattaatggcggtgttaaagcttcttaaattaattcgaatccttcacagtagccagtgttcgcagttgcgatgtgatctgttctgccaaattaagcatcgtatggtatacattcgcctgcacttcaattggtttcggaatgagaacaatagatcgcgtcgtttctcggggcttggaaaaaacaatcttcacttgaacggtacacaagtgtttgcctttgaccactatctcttcattcaatgtttgaacgacttcaatgctgtcatagggaaaatactctggcttcaagttgacggcagaaaagcgtcgattgttaggtaaacataagagttcatgttgatcatcaaataaaacatagccgtttattcgacgtgtgatcataaagtttgcgctatcggttatcattttttcctgtggtgcttgttgtaccacttgcttaagatccgccaaagtcatgctggtgactgtcttagtgtagtccaaactagaaatcctgtaacagtatttacaaatatacccatcagcagttttgaatttgactaggcccaattttttatgacagagaagacattttctcaacctcttcatctccagtcctcaaggcgtcgcttatcaagagcgttgccattttaaggtatttctggtattgcacatcgtatgcttgcttcaaggatcggtcaggtaaaatgaccacatcatcttctgcttgcgcagttacgttatcaccatcaccgataagtgctaacatgacggcgccatcaattgcttctcgttgaaccgttcgtttgtgtacaggcaatccgaagacatttgcgaaaattgttagccaaagtgtgctcttcgccccaccaccaacaatacgtataaagttagttgccgcacaattgcgcatctgctcgtataactggcgacatccaaaggctaatccttctagcacggctaaatacatattatctttagttgtttcgaggccgataccgataaaagcacctcgcaggtttggatcggcatataacgtcttttcaccgttcaagtgggggaaaaacaaaactgtgttcttccccagcaatcttcggggaatcttccgctgttcggcatcagcatcctcggtattgataattgatctcaaccaccagtcattgagaaccgcaccagtttgcacgacgccttgtgtcaagacactttcgttttctgcgtcaactttgaacatgatattcttgccaatctgtttcagttggtggcggcgattaggcaccacgacgacgccagaagtcccaagcgaaatcaacggttgctgctcctgatccgtcttattcgctagagcagttgctgcattgtcaccggtgccggcaacaaccttaacaactgaaggtaatcctagttgattggcaagtgaaaactttaattcgccaataacatcacttgaagtatgaatagtcggtaaaatacgctcatcaatcccgaattcctgacatattttggttgcccatcgactttgtttgaagtcaaacaacgacgatgtcgaagcatcacaataatcagttgaatagtgccctgtaagccgataaacaatgtaatctactggcatgagtaaatgctgtaaagctttgaaatggcttggctcctcacgttttaaccaaatcagatttacgagcgggcttcctgtggaaacaatcttagcattttccgattctctaatgatgtttagctgttttttcaaacccactaccagcgccttagtccgtgtatcattccataaaattgcgggacgaacaatgttaccgctttgatccagaaaaacggttgtatgcatttgtcctgtaatcccgatggccgcgatgctgtccgaagaacgcgcgtgttttactaattgatgtagcccagttaagacaatgtcaaaccagatgtttggatcaatctccctggctccgttcgctgaattcatatattgataggtttgctgataaccgtgttgcaaggaaaggtcctgatcaaacaaacccattttgattgaggaggttcctaaatcaatgccaatatattgcttgcccaatgatttcaccttcctgaggatcgcctaatcaaacgtcaccatcgtcttcagcgtttctggcagcatagcatattgaaacgcgctttcagcatccgtgtatgggaacgtcttatccaacaacggccgcagattgagtgcttttttgcttataagctgagttgctcggaaatacgtttctctggtaggactcacggtgcccttgataaatttttcgtgtgcatgcacggcaccgagatcaattgaaacgggatcgtctggatgcatcgaactaaacatgaaagtttggccgccattggctgtaaaggcaatagcctgtttagcaattgccggcactgcggttgtattaaagacaacatcagcaccgcgaccatccgtttcattcttgactaacgcaaccggatctttctgcataggatcaaaaacaaaatctgcccccagttctagcgctaatcggcgccggttttcattgggttcgctaaccagaacgcgcgctccctttaacttcaaagtcatcacgtgtaacaaacccatcacgccgccgccaataaccaaggcatcttggccaagctgcacgttcgcccgttcgacactgttaatcacacatcctaaaggttccgtaaaggccatatccaggaaagacgtcgtatgaggatatttgaacaagtcagttgtcttaacggccatcaactgagacatcccccagaaacccgaaatgccgtagtcgttgtgaaatgttggtgacgagtatatttccgtacataaatttggccggccagttttgcaataatagcattcaccacagtttggcagaatatatttcacaacgtggtcgcctacttgaaaatgcttgggattaacagcgttgccaactgcaataatttcgccgctgaattcgtgaccaccgactcgcggataagtccattttgtatcacccgtataatcgcgaacgtcattttggcataatccattggctcttatcttcattaaaatctcatcaccttgaatcactggatcaggaaatgatttgatttcaatctgttttggcccattttctagtactgcttgcattttgataccaacctttctaagcacccaatatacctgtccagccacctataatacctattaaaatcatgatccctatgatcttcaaagaggaccagccgcgtttgagcatcagtaagatcagcagggtaaacgcaaagggcagaatgttgggcattaaaacgtcaagcaattgtttctgaatactgaacgtttgcgttgaggtaacaatcttaaggggcactgtcattttgacatagcttgaaatcaagccccccatcaccatgcaacccataatttcagcacctctaagaattcgatctaagatgcctttttcgaggaaatccatgacagattcagcaccagcgcggtagccaaacataaatgtgccataactgagaccccatgaaatcccgaacatcaggacgaaataaatgatggaaccccagatcgtaccttttctattcatatcaatacaaatagccagcaagattgggatcaaaacaccttgatagatcgtatcgccgacaccagacagcggacccatcatcgatgtcttaaggctcgttatgaagtcaccaggaatatcctttccttttgccttctgttcttccattgcaatgatcatgccaataataacagcgccaaactctacgtgaacattaaaaaattcgatttcgcgcttcatcatatcttttttcttctcaggttcattgttataaaacttcttaacaataggcgtaaagacatgagcgatggcttggcccatcatccgctcatagttgtaacaggtctgcggaaaattttcccaaatgagccaagatttaatcaagtcaccttttgttaacaagcttttgctatcttttgcggtcacctgcattttatcgtcactcatagcttgggcccccttcatcggactgatcctgattcttcgttacctgaacataaacaactgcaacaagcgcagcaataacgccaagtggtagcagacccaaaccggagtacgttgccagcacaaacccgatgtacaagaagactcgcgaatcgcctttgtaaatgtattgcagcgtaatggcgaccccaagcgctggcatcataccgccaatcactttaaagatggttagaaccgtgccgcctaatgccgccacaaaaccagaaatgtaactggcaccgtagtatgctgccaatccacacggaatgatggtgattaaagccgtcaacaattgcgggtacaaaacattggctcgccaaatcttgtgatactggccatcctcaatatagtgatctgcaacatgcacaaagattgaaccataggtcattctcgcataccaaaccaaggtgcccagtagtccgatcggcaccgcaatggacaaggcagttttcgcatccaacccacctgtgattgaataagccgtaccaagaatccctgataaagccatatcggctggcattgacccacctgcggagataaatcctaaatagactaagttaatggttgccccaaccatggctccttttaaaggatcgcccaagatgacgcctgttaataagccacagacaagcggtcgctgaatcgtccatagtccaacaaagggcagattcccaatcgcgataaaatacaaaaagccacagaggaatgcttgaaaaatgctcattttattctcctcctaaataaggttggtaatttcaattaggcgttgttcgggtaccaactgataaaaaacatgcacctcttttgctacaagtttcttgatagcatcaatttcggatggatccgcagcaacattcttaacaaagggcttacgatccccgcgcaaacccattccgcctaggttaacttgcggcagttgaataccgttttccgccagttttgcgtaatatgttggcgactttgtcaacagtaagatgcgttccttctcgttgttgtctccgttcaagtaatccattgcttctttcacattcattgggtcaacacgaacaccacgtggggcaagcgttttcaatactcttcgttgaaaaggatccctggcaaccgtatcatctacaatgatgatgtgattaatccgataagtcggcacccatgcagtgacaacctcaccatgaatcaatcgatcgtcaacacgcgcaaatgtaatctctttcatttcgatacatctcctaatcattagtttccttagttaaatgcttattgacatcaataaaggttgatggcgcctctttaatcaacttttcgcagattgcttcacgaccattatttggattactcctcatcataaatgcttcaagcagcataggtagattcatccctgttatatgtcgaatatcatacgtacccatcaacgacacaactgtgttgaacggactgccgctaaacaaatctgtaaaacagatgacttcttcagttgaaccgatttcgtctaaacgcgcctggatctttgctcgcagcgtactgacgtcttcagtgggttccagcccaaaagctttaacacgctcttgtttgccaacaatcatctcagcactgccaagcattgcctctgctaaattgccgtgtgaaaccataataaattgcattttcccatctcctgcattctcaatctaatatttgtgataactcctgaatgaagtaatcaaaggtaggatgtctctttaagcgttctacaaatgtcgcatcttgaattattttcccaagataattccacagctgaaatactttcgcgttattcttttcaatggcgaccaggataaccaaatcaaccttattaccatctgtatcccattcgattggatgcttgagcaggataaccgagacaaacgtcgcaatcggcaatgggcttacagggtgaggcaatgcaactgtgccgccaaagtaactgcttccaagttcttctcgaaggcgaatagctttgtttatttcagtcgtcttaccagccactgcgggtgacgaaagcgttatcaaatgatcaacaacctgatttttatcatgaagattcgcataatcaaacctgccttctgaaaataagttgagaatttcctctttggtcttaaaaccatcaatggctaatttagtgaatggtgaaaaactctaaaagtgttttcataataggctttaccaatagttaagcgtataataagtgcaagcctcatttgcccgaaatgcctatgctttgggatttacccttgcacttatcgctgacctatcggaggaattgatcatggtttatcgtcaaaaagcaacgcaactgtcacttgaatcctttggaagcgctctgggaacaccgctcagcccggacaacgagtgggttcaatatgcagaattgatcccatgggccaaacttgaagaggcataccaattacagtttccttcaaaaaccggccgagcagcgaagccatttcgattgctttatggcgcaacgttgatcaagttgaagaaaggcctgaccgaccgccaagttgtcgacgatatccgtgatacaccagcctatcagtacttcatcggattacccgaatatcgcgctaagaagccatttgaacacacaacgttggtgcactttcgccaacggctttcagccatctcagatttgatccgcaacattactaatgacttcacgcgcgagcggttggaggccgatctacctgaggggacgcatgttttgattagtgatgcgactgccgttccggtcaagatcaagtatccccaagatacaacgctgcttaaccagagtcgtttgaatctcgaacaaatggtcacagatctggcccacgggttaggtgtggaaattccgcggacatacagacgtgaagcaaaaggtaagtggaccgctttttcgaggaaaccgcggcgtcaaaacaaggaacgccgcaaacagcttcaagctcagctacaatacatccgaagagatctgcgatatgtggcggaactgcttgcgcaaggcggtcagctcactgattggcaagcacagcgtctggaagtgattaaacaagtctatgagcagcagctcttcatgtttgagaaccacactcaccatgtcgagaatcgcatcgttagccttcaacagccgtatatccggccaatcgtgcgaggtaaggcaaagcagtccgttgagtttggcgccaagattgactgttccatgttggatggcgtgattgatgtagagcgtttcgacttcaattcatttaacgaaagcactgatcttgaagtaacgcttgaccatgcttttgacctagtgggtgaatatccggatgaggtgctggtcgatactctctatcgcacgcgagataacatcaatctgtgtaagaagctaggcattaaacttaatgggccaaagctgggtcgaaagcccaaacatgtggatccgaaacagcgcaaagccgatgtcagtgcggaaaatcgtcggggtgccattgagcgcaagtttgccttcttgaaaggttcacttgggcttgacttagtgaacaccagaacggctgagtccttggtggtaacggtggatagcgcgattgcattggcaaatatcgacctcctccttaagcttttttctgtaccaatttctattgtggtcgaacagggtggcctgcattatcaaatcaactataaagtgactgaaattcggccagaaaccgcaacctaaatcaccagccactaatttaattttcgaatattcgttttcagctggataataactaattagaatcgcgccgagtgcatcagtcaaatccgtttgctcagttgtaaaaatcacatcatagtcctcaatagatgtatctgataagtcggtgacactaaccattgtgagtaccgagatttcgttgttgaaccacgttgcaaagcgctgccgcaacaaaacactctcactgcgttttaaactggtgacaaccaacactttctgtgatccagaaagatcgttgtatctaatcaagtattggttaaaataaatagccagataggagatttcactttcttcaacctttttgccaactttttgctgaatcaaaagacccatataagcagctatgtcgaaagctaatggaaatgatttgcgaatttgatctagtaaaacgttgctgttttgaatatcgaatttcattcgcgtgatgagcggcatgagatgtaacgctaaagaaatgcgtaaatcaatttcttgcgtaaaatccacgtcaaacttttctttaatgtcctcgagggcgctcacaatgaattggtttatatctgacggaacataatcgtcattctgataatcactcttacctcgcagataaatcgccaagttaagcaactctccgtcagaagcttgaaaaccaaatcttttctctaatccggcaaagatttcttttgccacttcaacctcatcagcaaaatagtgcagaaggtgaggttttgctgtgttcaacgaaaagcctttttgaatccgctgaatggatacttcaatgtgaacaatcaagttttggaataatgtgtcggaaatatggtaatgatgtgccatcagaacgttaaccagaatccgttcaatatcttgccgataaggtgcttgcgtaacataatgctcgttttcgtacaaacccatcttggaaagacaacgccgcatgtttctctctgtaccaatcacttgaatgccattttgggaatctcgattaatcttcagttcaaacggttcgattatacctgccattttgtttaaatcagctgtcaaagtagatccagaaacgaatagacgattttcaatctgagtttttgataatggtcgcttttgttgcagtagcaaccgacaaagtcgcttgactctgcccgactgatctaaatgagatgtgctgtgagggcgtaaaaattcactttcaaaagccggaacatctttaacaatcaatcgagaacctaaagagcgcttagagattagagcggcgctttcattttcagctagctttattcgaattttcttgatatcagtttgaaccgtgcgcacactgacttgatacttttgaacaaaataattcgaggttaaagttttcggggcgtgccgataaaaatcctttagcatttctgcttcccgactattcaacacgctgctcaccttcctttacctataaagccccaactttctcgccattaacttctttgatgatggttttggcagtctcgataacgttttggatgcctttagtggccaccccataaagattgaattcattgtggttctcatcatatgcttgaccaaacgttttaatataggctttgcgtaagtctgatccataattaatcttgattagatgatgcttctttgcacggcgcacttgatcaaatggaataccggatcccccgtgcagtaccaatgggacaggcgaaattgccgcaatcttttgcaataatggaaaatcaaggttcggcgacaaatcaagtccatggacattgccaactgcgacggcgagcgtatcgcatccagttttttcaacgaaactaaggacatcttccggatgggttttggcattaatatctgacacgtgatcgtcttccttgcctcgaatccccccaagctctgcctcgaccggaacgccaaagtaatgtgcgtaatccgtcgcccgcttgacttctttgatattttcttcgaatggcagctcagaagcatcaaccatgatagaggtaaaacctgcgtcaatacagagtttgacatcttcaaagctcttaccatgatccaagtgcaaacccatcggtgtcgaaacgtcttccctttccatcacttctcgcgtcatgttcgccacaatttcgggattggataattttaagttatgtgaagaaatttgaatatagccacccaatttcattgcatcaaaagctttaacaatcgcaagcgtcatttcataatttgtggtattaaatgctggtaagacaagctggttgcgtttggcgtagttcataagtgtatatccattaactaaatccatcatttttacttcctttctttacatccttaatcctaatagaaagcgcttacttgagtacgtcaataaattgcatgaaggttcatgcaattgccgactgacgcgtaaacgaaagcgatcctgttcatatgtgatcttttcttctccccgtgcaagtgacacagtttaaaaaaggcctcgacaatcccggatatatcgggatatcaaggccgctcctattgaggctatctttgggaaacgtatacctataatacgatgcatgtcgtacatttagtttcactaaaattcttgttttagtgctatttcagctcaaatctgactttagcatcgtaaagtggtttatattgatgctcataaacatcaagaagcgtgcgaactaacggcgttgtccgcggagagaatcgatgactgggtggttgagcgagcagacgatttttctcagaagtcgtctgggcgatcatatttgcccctcgtgaaactgcttcaggtgttgccattgccaagacatctgcatccagcaaatcagcttttaattggagccaaagaggatctttgattgcaggtccaataacttttatagtttgcaaccgttgattggttaaacattcaaccgcatgctttaactcaaacgataaccctaaaaacagtccaaatatcaacgcctcttggtcaatttgattcgcaagaccataccaaagtccttttgtctgtgttgattttttcggactaccactaccactgaaatgcggaatcacaaagttgatcgcttcagtgggcaactcctcagctaagtagcgcttataagctgaatcggccaatgccataaaacgtcggctagttagttggtgacgctcttgaaaccattgaatgacagaaccagctgatggcaatgctgtaaaaattgtatatagatttggatctaaataaacgccgtatgcgatcccttctgcctcttgggttgcttttttttctaacgtatctgaaagcagtagtattccctcggtagttcccgtagaatcaagaagttcatgcgttgtttgtccacttgagaccgaaccgaccatatgatcatgccctgcaattgtaactgccacctgatcagatagaccaagtgttgttgcgatagcaggcttcaaggttgcaatcttggtacccgatggataaggctgggggaaatcaacattttcaattccgaaaatttttttaactcgactcgaccaatgctttttctgaatatcaaagaccatcgtgcggcttgcaattgaatattctgtagccctaacacctgtcaattgataaacgaggagatccggaatgcataaccacgtatatcgtcggtttgcatcaacactatgctcaagcagccacttgattttgctggcagaatagtgcgcgtgcggtggcaaaccgactacctcatatatggtctttttttcctgcgaggataacctgttaataatttcttcagaacgattgtcataccaagcaatcataggagacgccaattgaccaagttcattgatcaaaacaccggactcgccaacactcgcgaccgaaatcatttgaatcgtatctggtgccgcttttactagttgccgaattgaattcataagttgtttcaataatttttcagtgtcaaagtcgacaaaatcatccactttattcttaggcgttgcaaactttacttgctgaatgggctgaatgttcgtttgctctgaccaaagtgagactttggtgttagtggtaccaacatcaattgttagattcgtcaagactatctgcctcaccaaagaccgatttctttgtcactcggtataaccaccaaataatcaacccaattaccgggatcaagccgagtgcaacaggattaaactcaaagatcttaactaaccaatatcgtagtggattcccaccatcaagaaagctcgttacggccgaatttttagcgccagaataattgacgttttgcgccatcttcgtaattgtccctgctaatgctgaggaaatatatagatctgcaattagacatggtatcccaataagaagcgaacggaaaacatctcctttagttgctaaaacgatcatggaagcgaaaacggccaaattcgctaaatcagccagcggcattgtgccattacctggcaagaagaaagcaagcacaactgcaattggggtcagaatcaatccggtagaaatgactgcaggattaccaattgccacagcaatgtctaatccgatgtatagctctccgctatttttgacgtgcttattcagccaatctttaaccgcttcagaaataggcatcaagccttccatcaggattcggaccatccgcggcaagataaacatgacggcgcctaaattaacaccaatttggagtatgccacgaacatcataaccagctaacacaccaagcagaatcccgagaagggttccaatcatcattggttcacccatgataccaaagcgcttctgaattgtctgagggttaatatggattttgtttaagccaggaatatgatcaataacccagtttcccagtaagcctatgggccaaaaagtaattgatgaaacggttggcaatgaaatgccctcaaggccaaaatatttttcgcctaatggtgctgcccagtcagccagtttaaagacaatcaccgtaatcactgcagctgcaagtattcccaaccagaaattgcccgtcacgtagtaaaccaatgttcctgcaagtgcaaagtgccagtagttccaaagatcaacatcaacagttttagtccacttcatccccaacataataatattaatgacaattgtcatcacgatgacgaaaggcgcaatgggaagcccccaagtgatcgcggatagtgccggccatcccaagtctgcattgggtagactcagaccgatgtgtttaaccataaccttagctgcggggccaacattatctgataaaatcgtcataacagcattaatgccaacaaaaccgatcccaacagttaatgccgagcgtaaagcctttgtccatttcactctaaaacaaagggcaagtatgaagaggaagagtggtaacatgactgttgcacccatacctaatatatattgaacaattttatttagttgatcggcgagttccgacatgctttctccctctattcttcaatatgctttttaatatcttccagcactttatctgcaccaattccagtaataagtggcaaagctcgaataaccggaatttcggtttcatacggaacgttcgttgttgcgacaataagatccgcatctttttgatcgtattctggcaacgaagccacatttgtttgcgtatagttggcatctaatccatgttcatgcagaaagtccattgttttctctgcaacaactgtcgacgtcgcgatccctgtagcacaaacaaataaaatcgtctttttctttcctgaatgagtcattctaatccctccaaaattgcattttgaacttctgttgctatctcagcatctgtagatgtcataaactttttcaatttcgtctgatcttggacaacacgcataattcgcttaaggatattaagctgtttgtttgactgggccagcgagagcaagaagatgactgatactgggataatttcattagtcgtccccatgacgaccatctcaataggctcagcaagaatgccaacggaaactgcattttggttaacgaactgaggatctgtatgcggaattgcaactcctattggggatgttggtaatcctgttggaaattttttctctcgatcttttactgcctgtggataatctaccgttacaagctttcgatctagtaaatttaatgatagtgcatcgatagcgccttcaaatgtaaccgatttcgtaaaatgcttaacaaaagaagatccaaatgcaatcttctttgatgtttgttctgacatttaaacctctcctatcgcacggctgttggtgaattgctgttcatgacgcaaattttatgatagacgacatcttcgatagccttttctgcgtcaagcgatacgttaacaagatcaaacctctctggatccttttgataatcctgaccagcagattggatgaaggcgcgccgcaaatcactggcaacattgattttaacgaccccgttgtcaaccatttgggcaatttgctcatctggaatgcctgaagcgccatgtagcactagcggaactgggcagatagcgtgaatcttctccaataggggaaaatcgatgttaggatcaagatttaatccgtgaacattaccaactgcaacagctagcagatccacaccagtacgttcaacaaaatcaacaacttgttctggattagtcttgttatggccttcagttacgtcgtcatcttctttaccagcaattgcccctaactcggcctcaacaggaattccatagcctctggcaaactgaacagcttcatacgtatgttgaatattttcttcataatcgtatttggcattatccgtcatcaccgatgtaaagcctgcacgcgcggcttggcggacagaatcaaaagtcttgccatgatccaagtgtaaggcaatgggtgtatccatttgttttgcgaatcggttaaccatatctttaataaatccatatccagaaacggggatgtttgtcggggcaatttgaatgaaagatggtatgccgcttttttcaaccgctcgaagtatacccatggttgtctccagattagttgtgttgaaagctcctgcgacaacgtgccgatccttaataattttgatcaaatcgaatccatttactaatggcattggttcaattcctcctatcgtctttgcaaagttgttgtgagaaagtacttatttccttttaaccagacggaaccgtattcgactggttctttttcagaaagatacactgtctgttgcatttttaaagccggcgtggaagaaggaagctctaaaagtttcccacgttccgtgccaatcgtaagtgcttcataggtactgcgggcaaagctaatctttctttttgctagttcttcaatctcattaaaaaggctaatgttgttaaaattgaccttctcaattcccggacagagcgtaatattaatgcgattttcgattaacattaacttatcatcggcaactgatcgcaatcgttctaaatacaagtactgactatcaatagggatcttgagcatatcagcaattttcgcggtcgcgggtcgtagttcctgctgaataacttgtgttgtgtaacttaagtgttgattatcgagcgactcagcgaatgacattaactgatcattcaacgagtactcaacgtttgggttactgacaaaggttcctttcccatgaatctttttgaccataccctccttcagtagaatatcaatagcttttctaacagttccacggctgacattaaggttgcgacacatcttctgctcagagtctaaacggtctccatcctgtagacttccgccatacatcatgtctcgcaaactatttgcaatttgttcgtaaactggaatcatagacgttttgtcaatatcaattttcattttcccgccatctttctattagtttacgaacatcatagaacaaccgtgtatcacagggtacctctgtgaacaagttaaatataaaagccatttatctcttatgcaagcgctttatcttttttaaataaaaaacacgttctcatattcatgaaaacgtgtacatgtttattatttaaggtacaaaatcgatttattaatcaggctttggcgatgatattggaatacaaaagcattcactgcgcaaactcgccaattccttctaaccgatctacaaggcttcattgacggcattgctaaactcagtgaactgtgtagccctaagcctataaatcacaaaatttatagcgtaattatccaagcttcttcaccaaaaactgatccatcaactgatgctgtgcattaacaagtgggcgcggtaaatcagtgaagccaaactcatgataaacatgaacggcggttttaagcgtgtggtaagtttcaagataaaccgactgatacccgacttgccgagcgtaatccaaggcatgctgcaacagacgcttaccaatgccgtgaccttgcaaatcaccgtgaacatagaacttttgcaattcagcaacaccgtgagtcgggtcatactccgcaatgccaaccccgccaagaacgcgaccattttgcgtggccacaaagtaattccgctttggctctgccgcataaaactgacttaagtgatccagtccagcatcaaaataaactgtacccgggcggtcaagatcggcggctttcagacactcccgaatgagtgcggcaactggtgcatcgtctgcagctgtcatcggacgaatcacttcttcatgaactggtgttggcatggacatccctgctttcgaaaaggtttaagcaaaatcatagtattttttcagctaattgcaaggcttctctgtgatattccacgaaaactggccagacacggaatgtttcacggggaacactctcatctcggggttattaatgattccttactatgcactacccgcccttcacaacatctaatcaaactgcgtcacccaccccgcatccgcatgggcagcaaacgccatctcgatatccgccggtaaattacgctgcagtgacagcggtaacgccaacgcctcctcacgggtaaaagtgcggacattttcggtttcgacgcctgtctttaatgtttgcgtcaccggctggcaggcaatgaaaaacttgtatacatcctgcgtgctttgcggtgcatagtcacgcttccggaccgaataaaccgcgagcagttgcgttggtttgaccgttaagccagcttcttcgcgggtttctttaactgcaatctcaccagcactataacccaagtccgcccagccgccgggaatggaccaagtgccacctgcccgctcttgcaccagcaaaaggcgatcctcaataaacgttaccgcccgcacgtcaaccttgggcgttacataaccgatatcctgatccacaaataagcgcacttgctcaggggtcgcatcgctcaattgcagcatcagttgcttggtgatagccgctaattgatcgtaacgttcccgatcaaacacatcttttgtatagtaacgaccagactgcgcaatagcctgcagttggcccaataacaagttcaagtcttcgcttggcatgccctcgcctcctgcgatcattgtagcaaaattgcagctaatgccggtttaaagcaaagaaagcttaacttaaaaagattgccgatacacgaccggcaatctttttaagttcatgcttctgacaatcatccgtggcgtctgctgatcaacaagtatatgccttccacaattgcaataatcaaaatgaaaacgaccagcacggctaatgccgctaaacgtgatgccgcggtctcaacatggccggcaccatccacgcgtctcatcaagatcctgatgccgataccgctgatagcgattgccaaaacgatattcgtgatccagagtcccttatgtttcaaagctattgcccccttttatctcaaggttttgaaagtacggtccagtttttgcaaactagcgccgattaagggaagcagtaatgtcatcgcagttgccatgtaaacaagttgcaacccaaacgccatggcgaatagattttgccacgccagactgaacagcacagctgccagaaaaacgcatagaccatgtaagacttgcggctttaaccattgctgccaccagcttagtaagagacctcccaaaaagccgagtacaaagtctgtcagcaataacatttccggtcgcgcaacataacccaagcggccaataatcatgatcgcaagcgccggtcccagaaaagtgactggtcgcgccgaggttttcttggtggctttggatgggactggcctcagcaattcgtcaacggttatttggtaaaaatcagctagctgacaaaccgtttgcaaatctggctgatgtcggccggtttcccacgttgaaacggtttttcgcgaaacgaaaagctggtgggcaacttgcgcttgcgtaagctgtcttgtcagtcgtaacgcctttaagtgattgcctaaaaccgaagtggtcattctgctccccctctaaacatacacggctcctgtacgaaaagcctagctacacttgctagcacacttgatatatcaaggttttaaaccattttacgattattcaggaacgtttaaataacggtcgtggaaatctgtttctatcattagattatcataatatcatttgcatcagaacccttggagccttcgtccgtttctacgcataagcgttaagatcgcaagtgaccacggattgtctgcttctgcttcgactcctaaccacagtcacaaagaaaaaggctggcaccgtgatttgcggtgtcaaccttttattggcctaaatggcaacgtcttaatcgttattcttgtgatgttgacgcaatttgacgtaacctagcagtccgattaaagttgcgccgagaacagctaacaccggttgagcccgatcaccggcattcggcatctgatcgcgatccttagttgacttgtgcgtgtctgccgattcgccgttgaaacccgcatgcggttgtggagtcttgtcttttggcggtatgcccggttccggcgttggcactggtggattgccaggatccttacccggctctggcgttggtgccgcctttaccaggtgatcaatggcggctttaaggttggcaactgcggcttcaaccttagccaccgctgcttctgaatccttgttaaccgcccgcgcttgggccaaagctgtttgcaagtcggcaaaactgacatcagtgtatgtctccgctttaaactcggctgctttggtgatcaagctgacaagctcggttttgtccggttgcttttcaagttgtagcattgccgccattaaggcatcggcctgttttccaacttcagcttgagcagcattgggatcattcagaaccaaacgtgccggttttaaagctgtttgcagtttggcataggaacttgcggtatagtcgctagctttcagtttttctgtcgctttgacaagtgcagcgagtgattgtttatcggcccgtggtaccaaagcgtcaatggctccctgaagttgatcggccaacttttgctgtgtcgccgcagacgttgttggatccgttagtgcctttttcgcttcatccaaaacggttgtgagttgggtaaagctgtttggcgtgtagtcggcagcatttaggttggccgctactttaacccattgttctagcgccgtggcttgcggttgttgcttcacttccagtgcaaaccacgcattgctaattgcctggatggccgcttgaatttgcgcttgggttgcatttgcatcggcagagactggtttggctgtagcaacagcatccgtcaattttgcaaaactctccgccgtatactggtcagcttttaacgcttcagcagcttcgattaactttttcaactgatcctgagtcacgccgcggtcagcctcgagtttgcccaaagcgtgcttcaggtccgcataagcttgattgagcgcatcaaccgttacgttatcaacgttgagaacttggctcgctttatcgcgttgagctgcaaccgcctgccaactaactgtggtaaacaacttcggatcgagtgcgttaatgccatcaattaaggcggttaattgtgctttagcctgatccagcgcgctcgtatccgctggcaaaatggtgatcggtgccggtacttgcggcaagttttccggaccccactgattggttaacattggatcacttaacgcaaagctgagtgccgctttcgtcatgcgggttttggctcgcaacgtgatggtcgctaacttttgatcgcctgacaagcgcttctgctggccttcattggcaaaaatcagatagagatcgcgactgttatcaccatgcgttcgcgtcttgctgaagttaaccatctgggctgtcgcttgggtcggttcaactttgactaactcgacattcggattcgtgagcggtacccgggcaaagaggctgttgacgttggctagatccttgccaagcagattcaaggtgatcgtttctcccggcagatacgtttgcttttcagcttcaagtgccaaagttccggctggtgcttgttcatccggcttcgtcaccggcgttttgcctagcttggtcatgacatagttgatgtcaaaagcgtcaatgaccccattgcgattcaggtcgccgttttgaacataaccgttgaaatcactgtcaatgttggccgttaagcccgcgtagttcataagcgacgtttgatcgtcttcattcacccgtccgtcattggtaatatcacccaacaccgctttgcttgagccatcccgtttaaacagcagcaattcccgtcctgaaacaaaatcgccgcggcttgtgcctttagggatcacaaagcggacatattgggctttttcatttttgtcaaaagtgattgtcttgtctttgccatcccacgtccaacctttgccttcacctgcttgatgccagtgaatcccatcaaggctggtttcgactttcaatgctgacaaagtaccgttaccgccgtcttcacgcggaacataagtcacatgatccaagtcgtaaacgccatcaagttccgtggtaatcgtcatcggtgttgctgattgcttaggcggcgtggtgaaccagttgctgtgcgccatcgtagtcagatcctgatcaaaaagatgagccgcggtgtcttttccttgccaagtagcgacaccggtaatcggtgatgtgacttgcggattgctcattttgacggcaagccgcagcggattatctttggaactgaaagtctgctcgttactccacttagaaaccgctttggccgttgctgcgcgtacctggaacgtgtgcttggtttggctcttcaccggcgttagcagaaattccggcttggtcagattgcggtaaacaacgccatctgccttgacgtcataacttgtcgcgtccttcaccggcttccagtcaatgcccacagttgtatcggtcgtggtctgatcattttgcttgatctcggtcggcactgctacttcatcgctctcgggtaatgcttcagtggttggatcatcagtagcattgataccgtccacggtgagcttgatcgcattgcttttaacattggtttttcccagcttaacttgtaaaaagttctggtcaatcgacttatctgcaagttgatccaagaaatcattcgtatgatattgtttattaacaaaataaacattttcgcctgcagtaaagtctttgaggttatcgacggcggtcagtttaaccgtttgtccgccaacactggccgtaactttagccggcttgccgctcgttcgaatggcaaattcagtggctcgatctggatttaagccgctgtaatcacctgtcagaggatcaacgttcacggtcaactgatccttttgcaattcgctggtaaccttggtttgggcatgcgcaccttttagatactttttcgaaatgccgtcatcttcgtaaaccgtaaaatcgtttttgccactcgccgggaaaatctgaaactgccgcttggtttggtcaaatgctttgggcgtattgtgtgcgggcgtggttggaatcacggcgccttttttaacgaaaaccggcaacttccaaatcggcgcttcgaagttgtttaagacctgaccgccacgatattccttgccggtgtaataatcgatccaaacttgctgcttgtcagggaggtaaatgccgttacgtacatcgtttcccttttcatcagccgccgtgttttggtaaatcggcgcaacaaggaagttatcgccccagaggtattcgtacttgaccagatcggtatatgcctcaggaatgttcggataatcaaggaacagaccgcgcaccattggcttaccatcaaagacactttgcgcagacgccgtgtagttgtaaggcatcagcatggtcttttgcttgttgtaagcacgattgatcgccgttgtttgctgatcaaacgagaatggcgttttgggattggcaccccagccgtccatgttaagctggatcggcgtgaaggctttccactgaaaatcgcgggtgttgacgatcggattaccgccgccaaaaattccgtccatatcggaacctacatacggctgtccggataaaccggtcccgatatacgttggaatatgaaagcgaatgtattcccactggccaccggtttgatcacccgtccacacgccggcataccgctgcgtcccggcccagccatcaagcgtaatcgcaaacggccgcaacgaatcgcctttgacctgcgtcatcatcgcatcagctttagccagaccatctaagccaaaagaatacccggacccgacccaggccacgtcagttttcagggccttgacaccaatggcaacttccttggcaaaatcacgatcatccggtttcggattggccggatcaactggcgacaagttttgttgcgtccacagcccggttgcaacgccatgctgatccgcataatccgcaaacgacttaagattttgcaagttgcctgctaaagtatcggtctgcccatagcctgcaccataaccatcgtttggcaaaaaccatcccagcggcatatcatttttctgataccgatcaataacggcgcgagcactaaattgataattattcagctccccgttcaacgattctttgataccactttggccagcaggaattttcccaggctgatattctttataatatttgccgtcttcaaacttaatcgcaccgcttgttccttcaggtaccggaacccaagtgtcacggttataggcattcaagtgtgcttcatacaggccataacgcggcatcatcgccggtgcacccgtcaagtcgtaataatctttcaataagtcatagggtttcgcatcgaaaaagtaaactgcatcaaaccgattttcctgatgcgtggtctttacttggccgtcatcgctagccccaaagtcatagttacccagcttaaacgtgttccgcaccacgccatagccagcggttgaccaataaaatggattcggtgacgccaccccgccatcaacccaattacccgtgttttcaatcttgacatttttacctgttagcgtgaaattaccattttgcgtgccaccgccaaaaaactggtcagtgccacgttttaacacttgtgtcgcatgatcgttggtaatttctaacggctgactctcggccatgaccacctttgagccctgggaaacctgcagagttgcatttgcttgattaaatccaatggcaatcgcatcggtcttgatcgtccacccatcaccgttatgatcaagcgtagcagccgcaaacgccttagctgccgatgcatcaatttccttggtaaaaatttttgcgttaagccctttttccgattgggcaggcgcagcaaacttacctgaaggatcagcataaaagcgaaattgattgttcgctaatataaacacccgtgccttcaggttgttggagtaagtaacttcaaaataatgcgtttgtttggtgacattcacaatgttgagcatgcttgtactggccttcttcaccgcgctacttttagccggttcggatcccttagctgccgttaccggaaccgtactactgacatacacgacagtcgcagtcaatgataaaactgcgctgctatataacagtgaacgcggcacccgaggccgatccttcactgtcttcattccattgtgcatcgacaaactccccctaaaaattgttgtggctcctccacgtggtcggtaccactcaaggggattgtaaccgcattcatttgtttacttcaaccacaaaatattgtctaaaagtggcgaaaatctattttctggaaatatttttcagaaaatataaactaaattattgttagggttgtgaactagatattgacgccatcgagtttcccgaagctttgccggtgcacaattaagaacaagagttatactagtagcgcttaattattaattttatacgaatgagaactgaactcatttcattcacatagtacaccatcactaaaatgttgaccaccggaccagttttgataagcgcaaaagtccagaaacttggtagcctctgattcagtttgcgttccttagttaaaggtataaaatggtgatactcaatagcatcaaaacatgattaatgccaattaaaaatatttcaaaaagaactcccattatcatttcaatgtgtttaatgatcatatatacaaaaacaccgccaagttaagacggtaaacgtcataactcagcggcagcgatttagcaaggcacgcacccctcaccattctaacttccggaggtgatcgccatgctaagaggaaagatcggagggttgggttacgctagaaatagcgttggccatcttggttttagcccaggcgtacttgatttacgccaaggcaaccaagatactaaaagaagctaaccgtaacggctagcttctaccaccagtctttctaactcgcgtcgaggtcatcgggtcgcaccccggtggcctcttttcaccttctttattttacctgacaatcaagcttgccgtcaaacaaaatccatctatcgaaaaccattttttgagattagcaagaagagtcgccccaacctatatgcatcagcctcaagccaacccgaccacgttttgctataatcaactccgtacataccctatccacaaaaaggaagattgatgctatggcggatgaatttattgcccatcctttgatcaccattaccaacgttatctggagcttttcgcgtaccacccggcagttgcagatcttgttgattcatcgcgcggatgatccttacgccggctactgggccctaccggaaacgactttgcgtgtgcgcgaaagtgctgatgcagcggcgatcaggctgattcgcgataaaatcggcgtgcatgtcaatcgcggatccacggagcagttagccacgtttacggacccggcccgcacacccggcgagcgggctttggcgctgacttacatgacatatctgccgacgatgcctaagttacggcccggttatggcgcaaccgatgcgcggtggtttgcttttagcgccactgccaacgattatcagttacaaaatggtgcgctcacgtttcagttagatcaacaggcggcgcatctggcttttgatcatgcgcggattctaggtgtcgctattcgccggatccgcaataaacttgattatcaacccagcattttgcaagtactcggccacaccttcaccttaaaagaagcacgtgaagtttacgcgccttttctcaatacgaccgcggccgccattgacaactctaactttaaaaagacgcaccagcatctttttgttgaagtcggcactgcccatgatcgcacgcgcagtggccgtccgcctaaattgtttaaacttgcctagttgaaaaatacccggaacccgcgtatcgtagacaacaaataaaagtctaatgtacttttatactacgtgagtttaagtaaattttactttaattagaaaggaagcctcaataatggctcattcaaatgaagcattgctcattattgactatactaatgactttgttgccgataaaggtgctttgacctgtggcgcggctgggcaagtgttggcccctcacattgtcgctttggctgatgaatttttgcaacaagatggctgggtatacttgccaaccgatgtgcatacaccgcacgatccgtatcatcccgaaagcaaactgttcccgccgcataatgttcgcgggacttgggggcgggcgttctttggttcgcttgcgccttggtatgcggcccataaagatgaagaacgggtgaacatgtttgataaaacccgctactccgcgtttgccggaacgccgctggatctgcgcctacgtgaacgcaaaatcgacaccgttcatttagtcggcgtctgcaccgatatctgcgttttgcatacggcagttgatgcttacaatctcaactatcaaattgtcgtccataaaaatgcagttgcggctttgacgccagctggccaggactgggcgctggaccactttgcacatgttttgggcgccgaagtaacggattaattaaccacggactgataaagaaggcttttaaagatgaatatgaatcaagcaatgttgacggatctctatgaattttccatggccaatgggtattgtgcgaccttaccgcatgaagaccaggccgttttcgatattttctatcgcaatgtcccggatcatggcagttttgttattgccgctgggttacaacaagttgttgaagcgttacgcgactttcacttcgaggatgcagatatcaaatatttgcgttcgttgaaactttattcggatacatttttagactatttaaaaacgatgaagttagcttgcacggtgacggctttaccagaaggcacacccgtctttccgcgtgagccgctgttaacggtgcaagggccgctgatgcaggtccagttgctggaaacgctgctgctcaacatcgtcaatcaccagtcactcattgcaaccaaagcccggcgcatcacggctgcggctgaaggacggccggttatggaatttggtgcccgccgcgcgcaaggaccggatgcctcggtttatggagcgcgtgctgctgtgattggcggctgtgccagcacctccaacgtcttggctgcacaacgcttcaacatcccggctgccggaacaatggcccacagctggatcgaagccttccccgatgaactcaccgcttttcgtgcctgggctaaagtctatcctgacaacagtgcgttgctggtcgatacttatgatgtgctcaagtccggtgtgcccaatgcgatcaccgtttttaaggaactcaaggcagccggccatcacccggttggtatccgcatcgactctggcgacatcacccagctagcgaaacaagcccggaaaatgctcgatgacgccggcttccccgatgccaaaatcacagcttccaatgcgcttgatgaaaccgtcattcagtccctacttaaagaaggcgcaccgattgacaactttggaatcggtgaaaagttaatcaccagcgcctcatctccggttttaagcggtgtttacaaaatgaccgcattgcaagcaaacggcaagtggcttcctaaaatcaaggtaagtgctagccgagaaaagaccactttaccaagtcataaacaggtttatcgcctgtatcactgtgatgatcaaacggcttttgcggatgtcattgcgttggctgacgaaaacctgcctgcagaaattgccgcggtcaatgccaacccgctggctacccaaacgcaagtcaccttacgcgatttcactgccgaaccgttattaaaaccggtcttccctcaagcacaagagccgctcacgaccgatgtctttgccattcaaaaacatatgcaaacagcactcggacacttaccagaagcaacgcaacggctcgttaatccggatctctatccggtttacctcacgccgaaattggcagcgttacaacagaaattgattgatgaacatcatcaaaattgatcagggcgcgtgtttttaggcgtttcttattttgagtataaaaatcaaaaactgcttcgaaagcaagattgcttccaaagcagttttttaatttcgtgaattaaacatcgccttgagctgcattttaaaccggcgccttagcttctttggccaccaagtcgcgcatatccattgcttcttcaaaacgattggtaatgatcccggtgacgtaacgttcgcgcatcagttgtttcattttcagcggatcatcaactgtccagacgcgctgggctttgttgaggtggctgttgtaatgttcaatgtggacggcttccaaatacgatggtaaggtggcgccggttagaacccgactcgttaaccaagccgttttcattttcggcgcaagggtatgaatgacgttaatactgtcgtgattgaatgaggagtagatgacgcgatcctgcatattgaactgctcaacgtaatcttgcgtcagcgcctcaatgcccggatagcggatcttgccggttttaaactcaatgttaaccatcacgtcataatggcttaaaaccgtcaatgcttcccgaagcgatggaatgtgttcgccattggccagccgcatcccttttagttgcgtccgggttaaatccgcaatccagccagtgccatcggttgtacgatcaacccgttcatcatgcatgatcaccagatgcccatccgcactcatctgcacatcggtttcaatgccatcgatgccatgctcacaggcatattcgaatccttgcaaactattctccggaaaacgcgccggataaccgcgatgtccataaattgctactgtcatcatgagcctccatttcgcatactttactgatcaaaaaccgtctgcgccaagctatatcaggcgtctgctttcaaggcccgcacatgagcttcaatttgatcgcggacttggcgaaaaaccgccaacaccgcttcttgcgaaccactcgccgctgctggatccgccagcggccaatgcaaacggcgaacggttggcggtgtcaccgggcaccgatcccgcgcatccccgcagagtgtcacaatcaaatcagcctgctgcagttcggcttctttgagcacttttgattgctgttgcgaaatatcgatgcctttttctgccatgaccttaaccgccagtggatttaggccgtgtgcttcgatgccggcacttttcacctgccactgacgccccagcaattttttggcaaatccttctgccatttgactgcggcaggcattccctgtacagagaaaatagacttttggcatgatcacgaccagctcctttgcgataatgatgtctaacgttatcttgatcatacgcgggttacggtcgttgggcaatatggatgcaactggcaacttaacgcttgtagtccagcaggttgccactgacggaattggtctttgaaatggccgtattcgtatcggcttccgcttcatctaaagccttcttaacatcggcaccgccataaatctgttgcatagccaattcaacattttgccgttcttcttggatattgctgaagaacgcacctgctgtggccgcattgatatgaccttggttcagttgttcaatcggaaccgctaaagcagggtttttcttaattgcatcagccaagctctttacttggttggctttttggttaaccgcaaaatagcccgtgccgagttgccatgttgcttgagacttaggcgtcattagatacttcataaactgccaagccccttcttggacagcggttggtttgtccttagtaatccatagacttgcgccgccaatcgctacaccattcgctttggtaccatccggatgcggtgtgaaggtcacgccgtatttaaatttggcgttcgtttgtaactgtcctaacatagcagaactttgcatgaagatgccgaccttttgcgccaaaaacgccgcgctctggttgttagcagctgctgatccggtcccaaagttttggaaggcgttttgtttgatcacgtcttgcagccaattcatacttttgaccatttccggcgagttcaatgtggcactggttgccatcgcttggcggccgttatcgtggttgacgacaagtgaattttgattggcaaccaactcttccggcagccagccatagatctgcatcgtcatccctttgaccgcacctttactcttttgagtcaacgcaaccgctgccttggtcacgtcgctatacgtcggtgacagtggcaaatcgggaataccatactttttaaacaggctctggttgtagtacataaccgagctggaggagttaaatggcatggaagctaacttaccattgattttataagcggctgtcacccctggatacaattgactcaaatcatagtggtcacgatcaatgaacttttgtaccggtaccgttgaattcaagccgatcatcatagactggttggcctgatcactttgaatcaagtcaggcgaaacattactgccgaccgtattggcatatttcataatcgacaattcataactgccggcgtaaatcggcttaaccgtgtatttggtctgactcttgttaaattgatcgactaagccttccagaaccttttcattcgggccattcatcgagtgccaaaacgtgatggtcgtgcgcccgttgttatcagcagcactggccgattgttggtgggtgaagaaaaagccaagtccgaaaataacaacaatcgctgcgactatcgcaataatcttcttatatgtggttttcaacccttcgtcccccctgcattcaaattacgcttgaagaatttctggccaataagcaacagtgccaaggttggtaacaacacaatgatcgccgtggccatcaccatcccccagttggcgaacgtatcttccgcctgtaactgcttcaagccgacttgaactggccggaaatcatccgagaaagtcgtaatcaacggccacaggtattggttccaatgggtcaggaacgtataaagggaaaaggtgatcaacatgctgcgactatatggcaccgcaattttccaaagaaactggaggcggctaaggccaagatacttaccaaagtccaccaagtcggttggaatctgcaaaaaggcttgacgcaacatgaaaaccccaaatgctgaagtgaaaaatggaatcgtcaagccagcataattgttcagccagccgagtgcttttaccgtctgaaaattaggaatgatctgggcttcaaacggcaacatcatggtgatcaaaaaggcaaagaacaactgctttttgtagcggaagttcataaacgcaaaggcataagcagcaagtgtacataaaactaattggccgatagtgattaatccggcggtcacaaacgagttaatcatatagcgaataatcggtgtggtgacaaatgcctgccaatagttattaagcgagatattggtggataagaagttccccgccgcaatatcttttgtcggtagtaacgatgcccaaatccccaacagaatcgggaataaaagtatcaccgcaaccaccgtcaataaaagataacgtgctccgtgtttgacatgtgtcatgcgtaatacaccttccgttctgtgaaatggaattgaacccaagtggccaaggcaataatgacggttagcacaatggattccgcactggccgttccaaagttgtggaaagcaaaggcatcttgataaatcttatatgctaggaaattcgtggcattgttaggaccgccgcctgtaattaagtcaatctgggcaaacattttgaacccatcaatgatttcaaccacaaacaagaagaacagggttggcgaaatcatcggaaccgtaatcttgagcgtctgcttgaattgtgaccaaccagcaatgtcagcaacttcatagtattctggcggcacactttgaaacgcactcagaagaatcagaaaggcaaaacccaatgccatccagacgctggccaaaacgatgacaatcatggcaccggtcggatcaaccaacaagttggcattggtgacgcccagcgcttttaaggcaaaactggcgaggccaacagacggattgaacaagaacagccagagaatcgaagcagcggcggcactggtgcccatcgtaccggcaaatgccgtctggaaccaactgatccggcgtaacttcatcgttgccaaacgtgccaaaataacaccaagaacgatggtcgccaaagcaaaggcaacgacatagactaaagtgcccgtcagactcttcaggaataaaggatccttgaaaatatcaagatagttaccgagtccgacaaacttagctgattcgccacgaatgttggttgcaaaaaggctgttgtacaccgtcatgaccatgggataaaaggtaaataaagttaggatcaaaagtgacggcatcaaaaaccagaatgctggcttattattttcccgaatcgttgcggcgagcttgccttgcgatttggccgtcgatttattaagttccttattaagctccataagcggccgcctccttaactggcgccacggcaatccgctcaccgtcatcaatattaaagagatgccattcatcggcattagccggcagtaataaattaagctcagcgccaaccgctacggtgaactgttccggtacccgactgaccaatgactggccatcaaagtcgcagaaaatcaaggtgtcattgccaagctgttgcaagctcttcaccttggctgtaatggtatccgggttggcaatcgaaaccggtaccaacttctccggccgaatgccaagatgataggaaccagccggcaagtcaaacggaaggacaaacgcattgtcagtccagaaagtatcgccaatgctaaagcgatcgccttcatcgctaaccgtaattggcagcagattcatttctgggctgccgataaacttggcaacaaattcattggcaggatgattatacaagtccagcggggtgcctagttgctgaatcttttcatcgtccaacacaagaatccgatcgcccatggtcatcgcttcgacttgatcgtgggtaacataaatcaaggtcatgccaatttcacgatgcaaccgcgcaatttcttcacgcatttcggttcgcaactgggcatcaaggtttgacaacggctcatccattaaaaccaccggcgccttggttgccaaagcacgcgccagactcacccgctgctgttgcccaccagaaagctcttttggtttccgatcacgcaaatcggtcaagtgcaccaagtccaacgcccaatccacgcgcttgtttttttcatcatcggttaaatcctggttctccaagccgaagcggacgttttgagcaacgttcatgaatggcagcagcgcatagttttggaaaaccatcgccagcttgcgatcttttggcggcaaatccgtcacatcgcgttcattaaaataaatccgtccatccgtgacactggttaaaccggcaatcatccgcaacagcgtacttttaccggaaccagatggcccaaccataacaaaaaattcgccaggctcaatctcgacggaaatgtcggatagtactttggtgttgccgaaatcctttgacacatttgctagtcgaatactcattcctcatcaactccttacactgagactaccaagcctttgtaaagatcagtgtcaagtcgatgtattaattatgtaagcattctgtaaaacgtatcgttccagcttgaaatttttcaatttaacgcttcatccgcggccatattcagcttgatagccatgcaaaaagcgttggtgaacgactgctattccgctcaccaacgcttttccacaaaagtaatctccactactactattcaatgccttcctgaacgaacacccgcaagattcgcggtgtgatagcaatcatgtaaagcaacgccacaatcccgctgtatacaaagacgaggtaattcttcgcgatgttttgaaacaggaacgtataaaagaaggttgccaccggggtcaccgaattattgatcgtcatcaacgtggtattgacccggcccaaaaaagaagtcgggaccgttttttggatttccacctgaatgacaatgttaggaatcacgatcaagaatcctagcactatcatcagaatcgtgccgggaatcgtcacgccactggctgttttggcaacattaaacacgccgcctaatgcgatcaaaagcacacaatccgctaaaaccggcccgagaatcttaaggcgaatccgtttctcaccactgatcgtactcataaacaaactgccaatcaaaatcccgatagcagaaccggtttccagatacccgatcggtgcactgcccagatgcagcgtattcgtgatgacaaaaggcatgccaaccgtgacgctggtgaagctaaaattcaaaaccacgccaaccatgatgacccccttaaccaatggacgcgttttgacataagccataccttgtttaaacattgccaatggccgactggcagcgtcatttttcgcggtcggctgccgcttggtcacatgaaacttcatcgtcagcataatcaaaaacgagaccgttgacgaaaccatttccacgaaaataaaggcttcaaacccaacaagcgtgtaaagtcccaagcccaacatcggtgaaaaaatcgaggaaatggagccagccgtggatgttagtgagcttaacttttgaattttccgttcattaaccaattcatggacagaagcggcataggcagttgagctgaaatcactgcatatgtagtcaataatggcaaaaagaacaaccggaacaagtttttgcacgccggaaaaccccggtagcgcccacgcgaacagccctagccccagcaaacgcaccagattgcttacgattagaatacttcgatgcggataacgatcaacaatgctgcccataggaacaaacagaagcaaactaaccagcggcccgacaattgttgataaaccgaaactgatcgccaggtgcgtttgattcagcagcatcaaccccatcccaaacgaaaacatgccgccactcaatgagccaattaggttgctagtgaaatctttaccaatttgaagattggattcccgatctgtaatcagaaccgggctggttgcgtgggctacctgcataggctgtcagcactccttcgttttcctcatttttccataataattattaatcatattataataattgctacaaaaataaaaccccgcctgcacacaaagtcatggaacaagacgcttgtgtccaggcggagcttaagccgctgccaactcaatttatatttcagtgtagtcgactccggcgctgctgaaagtcatccacgattaacgcaccaacttgttgattaaaccgcacggccgcttcacgctgatgatcaaacgttgtcaaaacaactgcatacaattgttcaccctcagccgcaaaacaagccgcatcgtgttcgcaattcggcaattcaccagttttccccgcagtccagccaacaaaattcttcatggttggtgccagcagcaacttggtacgattctgttgatgacgcagggcacgggcacaccagtcaccgtcagctggtcggcacggtggggtcaataaggatcgcaataaacgccacgttgctgcggccgagatccagttgtcattgtcggtatgcggctgcatcaaggcacggtttaatttggcgcccggaaactgctgatccaaccatcgccccaccgttgttagcccatacgttttcaacaaagcattggccgctaaattatctgaaaccatcaacattaaagtcaccaaatcgcgcacacaccaggatgaatcggccatgaaccgcagtacccctgcgccgccaaccggccgtggtaatactactttccgctgccactgactgggatcggcttgtgcctgcgctttaacataggcagcaatccccaacttaatcaaactcgccgcggggaaaagcacatcggttcgcgtaccaaaaagcacctgccgctcatcagcaagtaacaaagcgtgcgattcaccaaactgttgctgcagctgatcaagttgtgcaattaagtggtcatgcgccatttcacattatctccgatcgcaagccagccaccatcacttgcgacaagcggtgatgactaacccaagttactatcgatcatacacccacgcatggtcgtcctgccaagagccaaccaagtaacgcccaacctaatccggccaggaagtttcaatcccgaaaaattgagtcagcagttcccggcggatgtgtaaccaagcgcggtgcgtccgactcggataaattcgattagttaaacaaacaaagccacgctgcgtatcgcgatcaaatgcaatcgaagtacctgtgaacccagtgtgccaatattgatggcgaccttgagcccagcagcgccagcccaacgtccgcccaccaacacagtaacgctcaagcaacgaaaatgccgccggaggtaaaaccttctcaccatgcgacactggcaaaccagccaacagccgggtaaaagtcgtcagatcgcctaacgttgaaaataaacccgcgtgaccgctaaccccgtcaagcaaaaacgctttatggtcgtgaaccgtcccacgtaaaaccccaccgcgttctggcacattttcagtcggcacaaaattgcttggtgccactgcttgcggacaataaccggtcgcctgcatccccaaaggttcaaaaacatgctgatgcaagctggcggcgagtgacccatccactgccgcaattgcccagcctagtaatataaagttcaagtcagaatacagggtggtggtgtctggcggggcaactgccgccatcgttttgacggcctgaatcaaccctgctcgatcaagtgcatgcgcgttagggacgtcagcaggtaacccgctgcggtgcaacatgagctgttcgatggtgagttgtgggtagcgcaatccactgaccagcgatccagtcggctgatccagctgaattttccccgccagcagcaattgtagcaagcgtgttgtcgtgccgacgactttggttaacgatgccagatcataccgattctgaggcatcagtggcaaatggtcggcaccggtcccttgaaagcctaaaaaatgcacggcattctcgtccgccccgaccatactaaacgccacgccgaaaactgcctgctgctgaattgctgcggtaatcggtgccaacaacgactgcggttcagacgcttttgccatgcgctgcctcccaagcggtcaaaacatcactaatcacgccatcatgagcagccagcacttgggtcgccgcagcagcatccagaccggttttggccatcacgatcgcaaccggaaccttgtgtgcagctgcctctagcaaagatgccgcctgagtcgcgccgacaccagttgtttcggcaataatgcgttgcgcgcgatccaccagtttggcattcgttggcaacacatcaatcattaagttaccaaaaactttgcccgcccgaatcatcacgccagtcgaaagcatgttcagcaccattttctgcgcggtgccggctttcatgcgcgttgacccggtaatgacttccggaccgaccacgggggcaatggcaatatcggcatggttggcaagtaaactggcggccacgcaggttacggatattgctaacgcctttacttgttgcgcatacgtcaacgcgccaatggcataaggggtccgtccagaagccgcaatgccaatgaccgtatcgttggcattcaggttcaacttcctgagatcatgttcggcaagctcaactgaatcctcagcgccttcaactgacttaaacatggctcccatcccgccggcaatcaagcccactgctcgttctggtggaatcccataagttggtaccaattccgcagcatccaaaacccctagccgcccggatgtaccggcaccggcgtaaatcagccgcccaccgcgattatagcgctgactggcttcatcgatcgccgcggcaatctgggttgtttgcgtagcgatggccggggcgattttggcatcctcatggttaatcagcgccacgatttccggcgtcgtcatggtgtcgatgtgcatgctggcgggatttcgttgctcggttgttaagtctgcgattgacatatttatcccctcgaatcttcaactctccagttaattgtgatgttgcccgataattctgttcggtttgcttaatttcgccatgaaccacgccgagaaaaagaatattggcaacataagtctccgtaaacattgacgtcacggctccgattcgtaacaacggctcggtcggcggcaaggcaatcacacaactggccgcatcgcgcaatgggcttggctcggcacgcgtcacgacaatcaccggtgtctgattccgccgcgcttgctgggctgccaacacgacttctttcgtcagcccgctataggaaaagaccaccaccgcatcagccgccgttgtataatacacgcgctctaatgccgtgtgcgcatcggcgtcaaaaatagccagataccctgcccgaatgagttttaaatataaatcctgggcgactaacgccgacgcactcatgccgacaagataaatatgccgcgcatggcgtaatgtggtaatcgccgtttgaactgccgcttgatccagctcgtccggtaaatcgcgaactgccgcaatcgccgtctgactcaattttcgcatcatcgttggcaaatcatcatcatcctgaacaagcggatcgagtggcgtcagcgcaggggcttgcgtatcccgcaccaaggcgagtttaaatgattgcaagtccggatagtcaaacaaccggacaaaccgaatcaccgatgctgccgacacgccgctagcccgggcaatctgcgcagttgtctgagcgataaaggcctcggcatcggttaacacatagtcggccaaagcgcgattcaccggacttaattgcggcaattgcgcctgtaccttcgctaaaagtgccttcattcgactttatcaataaaagtagcaatcgaggtcttactctcattgggcaccatctgcgcagtaatggtaatcccttgcttgagtaagcgccgaataatcgcaatatcatcggcagtcaccgccactgatggcttaatcttctttgaccccggcttttcagacagattacccacattaaaagacgtgatcggcacgccaccgtcaattaacttcgccatatccggaatattgcgggtaatgacgaaaacctgatcagcggcaaacttgccattttgcaaattttcaatcgccttggcaaccgagctaatcgccaactttttccctgcaggtcgggcgatcttcagtccttgaatcgccatgtcatcacgaaccaccgcatcattgacgaccatcagccgattagcgcccaccgtattggtccacaccatcgccacctggccgtgaatcatccgttcatcaacgcgtgctgccacaattgtcattcgaatcttcctttcaccataacgtttgaactcagcatgtgtgctgatcgccgtttcacgttagtacttaacaagctggcggatcttcttttgaaaagcgtccttaaactaagctgccaatccagccgaaaatcgcgcctaagttgccgagaaccatgccgatgaggattaaaacaaaaatcagccgagtcgagttcatatgcttgcgtcccaaaatccaataagagaacaaggcaatcgccagcggtatcaaagcaggcatgatcttatccagcatatcctgcacattcatcgtgactttgccgactttataggttaaatcgagtttgtaattgataactgcaggaatcatcgcaccaacaacggttaagccgagaatcgaagcaccttccgtgaaagtcgccatgctatcggcaaaagtcgtcgccaaccgtgtcccttgagccagcccgacattaaataacttccaccgcacccataaaataaccaaacagccaattacaggaatcagcaggccaatcggttgattcgataaggccaaatatgccgtaatagaatagataatcgcattataaatcgcgacaaaaatcgtatcgccaacgccggcaaacggacccattaaccctgttttcaaaccggtaatcgctttttcattttcatcgttcatgcccaattgatcttgcaaggccacatccgcaccgacaatcaagtgtgccatttgcggggtggtattgaagaagcccatttccatattgagggcttgtttcatttttgccggatcatctttgtataaacgtttcagcgctggcataaccgaataagcgtaacccaagccttgcatcttttcgtagttccagcccagttgaagtcctaagacattgtggatgaaaatctgcttaagatcttttttggttaacttacttaatttcaactcagacatcgatctcgacctcctcatcatcgctatcaccgctgccgccattatctggcttgctcgggccattgctaccgttgccattgtgcttgcgttcgttagcatctaagacatgtaacgccgcgaagacgaagccaaccaacgccgtgcccagcaaagagaacgactttgcaaagtaagccattaacacaaagccgagaatgaagtatggaaaatatcgtttaatcggcagataccgcatcaggatcgcaatccccatagccggtaaaataatcccggccgtcttcaaaccggtcatcaaccacgtcggaatccaagcgttgatcgccttaaccaccgcagagccaaagaacaagccgacaaaaaccggtaacatccgcgaaactgtccacgggataataccataaagattgttacgctcgacgcctttataatcgcctttagccgccaaccgatccgcatgatgctggaaaatcgtattcgtcatccgcgctaaaatatccatctgggtcagcagcaagccaatcggaatcgccaacccgatcccataggcagccccgcgccctgccataatggcaaacgcactgcccatgatcgatccggaaagaaagtctggtatcgtcgcgccgccataagtagcgacccccaacgttgccaactgcaaagtcgcaccgacaatcaagccggttttcaagtcacccatgactagaccagttaccgccccaccaaacaccggtgaaaataatccgatcttcaatgagagtgcatcaagctgtgccaagccaacatagatggttagaaaaataagtgcaaaagcagatattgccatgatgtttcccctccctacaaagatttcattgctcaacctgattatggcgctatatgaaactcaatttcaagtatttgagttagataagtttacaatgaaattttgtttctaggaggacacggaaaatcgtgtgtaccaattcgcaactggtaagcccgttgcattggttaaacagccatagaaaactgtatgcggttaaagtctgcccattgccaaaatatggtagcaagaacaattaattgacggtcagaaatatatttgctattttccatatgcgagcggttacattgtgttttattttttaagggtaggagatatccatgaagaacgttctgtcgaaatctttttcagcatccgttaaattttcagtgatcatcatcccgttaatattcattcggatactttgggacaccttcactaaagaaagtgcgtcgcttcaaacctatctctaccttttcctccgcacattagctggggcttttgtcttctttttgctgttatttttaattggaaatctggtcagacatcataagtaatcccttagtctcgtctgtgggcatgaagcaaatcccctgccgaaacttttatcagtcagtattaataaacagaatgaccgcagaaagaaaagcacgggctactttcctatgagaccggaaatagtccgtgcttaatcgtatgcaataactttagcgaggttttacttcaactggaacttcaacaccaccggattatggtcagaatactgaaatccggtcgacacaacatggacactttccgctttgatatttggcgacagaatatagccgtcaatcaaggtcacaaaactttttcccggcttatacggctggtccaacgcgcgtactgatggtaccttcgccgctgccagtcccattgtcgggatataaaagccggctggtaactttgacttaggaaacagatgcgtccaggtttcgtctaagtccttggtgtgaaagatttcggcggtgtttttcaagagccggtggttataatcacctgccaccatgacgtagttgccttgctggtaggcatgattgatatatttaaataacttggcgaactgtgcctgttggattttgacattgggcgtgaaggcggacatgtggatgttcaccatgatgaattgcttaccgtttgccaccgtggttttcgttgccgtgaacgcgcgatccaagtcgataattttattgaagtcagtgtccaccggtaaactgtagcggcgggcgctatcgactttggccttactcaaggttagaatcccggacttagccttgccgatcggttgattaaacgggtaaaacagatacgccgaatcgtaattctggccgtaaacgttagcgtattgccgttgcgcattcgtcaccatctcgacttcattcacatgccgcgaacgatcgccatccggatcaatttcctgataaaaagcgatgtccggcttctgcgcctgcgtggttttgatcaccccattgatgcttttccgcacggcttgttggctataagcacgcgaatacttaccgccgtccatgaaaaagctataactgggcggataggagccgtagccgatgttgtacgtcatcgctgtgtaggtttgtccgggcttaaactgcgcactttgctgatgcttaaccttcaacgcttgatcgtctggcaaacgataataagtcgtaaaaagataaatcaaataaccgcctgctgccagcaccatcacgccgataagtgccgctacccatttcaatagtcgtttcaagccgccgcctccaataagtttgcttgcatttattatagcagttgtctttttccttgagaccggtacgattaaggaagtaagtgtcaggcaacgatttttgccaacggactgtcaccgcaaacatttttatcaagggagcttactttacatgtcaaccgaaatcaaacagatccttgctgcttttgaaaaattcgagaccattatcattcaccggcacattaaccctgatcctgatgcaattggctcacaaaccggactggccttgctactgcgcgcggcctatccgcaaaaaaccatctacaccgccggaccagccgcaccggatctggcgtggatcggtccgcagcaagacgtccctgccgctgcgtatcaacatgcgttagtcgtcgtgattgatacgtccaatcgtgaacgcgtggcaggttcgctttttgagcgcggggccatggtgattaaaatcgaccaccatctggaagaagaaccattgggcgccatcaactgggttgacacgaacgcttccagtgcatctgaaatggtgtggctgctgacccaacacagccagcacctgacgctcacgcaaccagccgccgcagctctgtatgccggcattattggcgacaccggccgcttcctgtacgatctgaccaccgctcaaacccatcgtgccgctgccgacttactcgccaccggcatcgacgctccagcaatcggccgccaagaagatcaattcccggaaaatgtcggccgcctcatcggttgggcacttgaaaatgtccacatcactacaaatggtgccgggtcgctgatcatcacgcaagctatcctccagcagttcggtttgcagtatggcgaagaacagcgagcagttggcaacatcggcaaactcgccagcattgatcgctgggtcgtgttcaccgaacgccaagatggcaaatatcgcgttgaattacgcggaaaaacgaaggagatcaatacgcttgcagtccgacacggcggcggtggtcatcccttagccagtggcgctgtggctgatgatgaagccgaagttcaggcaattgaaaaggaattagcttctgattgaggacaacttggatcaggaaccaaacgactcatttaactgtggttcagggtttgaataacgtatcctcaatacagcacatctgaatgaatgaagtttgcacttgggtgaccaaaaggaactaacaattcggtttaacttttcccttgctttggagtgcgctccaaggtttataacaaagtcagcaaataaaaagaaaagagattttacaaatgcagacttttacattaaacaacggtgtcgagattcccgcactaggctttggcgtgttccaaattccgcaagatcagacaaaacaggcggtattggaagccttgaatgtcggctatcggcatcttgatacggcacagtcttatatgaatgaagctgaggtaggggaagccttggccgcaaccaagatccctcgtgataagattttcctgacgaccaagatctggttaagcaattacggttacgaagcgactgcaaaatccgtggaagcctcactgacaaaactacaaacggattatttggatttagtactgctccaccaaccctatggcgatatttttggctctttcaaggctctggccgatctccaaaaagcgggaaagattcgcgcgattggcgtatcaaacttcaatagcgagcgtctggccgatattgtggcttttcaagatgctccagttcaagtcaatcaaatcgaaatcaatcccttctaccaacgcgagcaagacttaatgaacgccaaagcacgcggtcatgttctactcgaagcatgggcaccttttgctgaagggaaagacggtattttctcaaataaaactttaaccaccattggaaaaaaatacggcaagtctgcggcacaagtcatcttacgctggaactttgaacgcggcatcgtcagtcttgcaaaatctgtcaaacctgagcgcatggctcaaaacattgacatttttgattttgctttgacccatgaggataaagcccaaattgccacactggataccaatactagtcaattctttgatcacaactctcctgactcagtagatatgtttgtgaagtttctgcaagaaagagacatctaagattgattggccagtcttcacaaatcgaaaaatagtgagtgatcaaaattatgaatatcaaaaaagctgctgacctatttgatttatcaccagatacgttgcgttattatgaaaaaacaggaattgtgccgcctgttcatcgcgcagcttcgggatttcgtgattatcaaacgcgcgatttaaactggatctatttagtaagaagtctgcgccgcgcaggcatgggcattgatgctttcaggcaattcacgcagcttgctaaaaagcgcgagtcaaacaacggctcatcactcaagcaagtagatgctgcacagaaggcaatcttacaaaatcaacttattgagcttgacgagaaaattgccgaactccaacaaacacgaaaaattttggcttataagattgccacttacgaagatcacatcggcaaattcaagaacggtgaatgggatgcagaaaatcaagaaaagctatgggaacgctaactttttggctctcactatttttcagagaatgctagccaactggcctcaatttctgtagactcgctgttaaacgttgactaagtaaccagagtatctccgtagccactttcgaatgcagaaagttggctatttttttcgcgccaaaacaataaaccgatcctcaaacgttgtgacgctgccgacactggcaatcatatcttggagctgatgcagctttggcatagcctgattaacgtcaaagtttggaaactcccacgggataaccgttgcgtaataaacaatcgcgccaacatccgtgaaacgcattttgacaaacgcagcatctgccttcaagatttcaaacccgttatcctgcaattgcgtcaatacttgcggaaggttattgtcaggaaaagcgggtacatacgcgggatctagaaaccgtgacaacgagtaattgttagttgcgcccacctgctgcgaaacgaagatcccctttgagcgaagtacccgagcaatcgccggaattggcaagccgccatgactgttggtcacgatatcaaaatactgatctggcacctgcgccatttgtccatccggatcggcataaagcgtcaccccttgtggcaccaaggttcgcttcagcaagtcaatgttgggttgccagccttccgtgaccgaggttttaacaaccgggtgtttaaacgtctgcatcagctcgccaccccctgtgtccatatccaaccactcatcactagaccggagatgctgctgtacccactcactataatcccatggcagcgactcggtttcacaccgaccctttaagtgactaaaatcccaaccatgcattgctaggtgactttcttcaagccacgatgcttcttcattcatgtcgtattcacaccttttttaatttgactcgttcatttacgcaaacttttgtgcaaacggccgcatgtaagactccgccaactcacggtttacaatcgcgtgccaccagacttccggaatgacgccttttccgctagcagccagcaaagaggccgcgattgtcgcaacggtgtctgtatcttcgcctaaactggctgctgtcatcacgccttgtttgaaatcagtagcgttgcctgcgacccaaatggctgcttccagcgaatccactacataaccgctcgatttgatcgccgattgcggcagtgccatgaaatctgcggcaaacaggcgcttgaaagtcggtaattctgcctgctcatcgcttggtaaagccactagtgaaaagttcaccgccattaaagcttgagttaacgattttccatgtaacagttgccacaacgtttcgagataaatcacactgccaagtacagcgcggggatggcgatgcgtcatttgggtgtaggcacgataacttttggcgcgcgtgacaaatcgcggctcagcgtataatgccactgccagcggagccaggcacattaacgccccattaccattggcaaactcagaaggatccccgcacatggtcggctcggcttgctcaataacataagtgcgaatggccttagcacaggcattaccaatatcaaacaactgcccggttggcgtatacgcacctgtttccatgtaagctgttaatcgatccatcaatttggcatagctgtcagcgtgtgtcagatgatcaagtagcgccagcgtcaaagcagtatcgtccgaccacgtccccggcgcttgctcccagaaaccaccgcccaccatttccggagcaacagtgtatgtgccacgttgcttgaactcatatggcacaccaaacgcatccgcgacaattgccgcttgaagcatacgcataatccgattcggtgacattacctcacctccagttaatggtttaagtctagcacgcaaaaggtgaaaatcctcacctaatcgccactcgtcactttaattccgatgatgccaatgaccaacaacgcaataaaaaaccaagtcgccggttgtaactggtccttaaataaaaccaccccgacaataatcgaccccacggcaccaatgccagtccaaaccggataagccagactcaacggcaaatgcttcaccgccaatgccagaaacccaaagctgagaatcatcccggctaatgttgccaaagcaaagcccaggcgcgtaaaaccgtgagataacttcataaaggttgcccaaacaacttcgaatccgcctgctaacactaaataaaaccactgcattttcttgttcctcctgtcatttaacccgtccgctacccaataaaaaaggcgacagtatccgcaaccgctgcatagacctaatgcggttgcgatactgtcacccggtagtgactggttattgaattgcgattaatagttatcttttcacatattttagggggtgtcaaattagacgtgcacgatgacgatgtaagctgtccgcttattaccgccgaggcttggccattccttttttgaatcacgacattgacggctatcaattgttcctctattaaacattccacgttacttatccttcaaatagtcaatgccggttttatatttgtccataagattctggatggtggtaattaattcctctttgccttccattttacacccctttataacacgcatttgcactgttccatcttccatcatgttgaatcgaaccttggtattcttctttataccgctccgccgtctaatttcggcaggtatcgttacttgacctttgcttgttacggttgcttctaagaactttttatgggacaaagacatacgtgccacccctagctttattcttactttttgtgtattaaagtttaacatagggtaaggcgaaagtaattatagttcgatctccttagtcaatttttttgagcgtatcaaccgcttcatcctcggctatatattatgagacttcattcagaattatcagtcgcttcattgacaaatcgtaaaatcctaacgctgactttaaaaaatgatcagggtctagaactaccagcgcgttctccttctcttttctggttatttcaggtttacaatatggcgacgagtcatcaatggtatcttcatattcgatactgtcttcccacatttattttccgatgaagtaacgaactatcttaaagtgaggtctaatcctatgcaggcattttataaacatcatcccgccacggtctggcaaatcagcaaaacgaaccagcgtcctgattgggtgcaagaggcgtttgatcaaaattaccttacgtggttagatgatcgccttcgaattgtcatggccggtttgtattcacccatgatcccaagcttgcaaaacgaaaaagccgatattttccatgatcatggtgttatgttcggcatcacttcgatcggttatttaggggattatctagacgttacaaatcatcgtgttgtcacgaaagaacaattttcaaagcactatcaaatccatgagccaggtacttggacataatgggtatttaaaaagcaatcgcctcgtctccaaaaactgacgagcgattgctttttaattgctacagagtcagtgaaccctgtcaaacactttagaaattccgtgcaaaagaccagagaatgacccactgaacaaaaacaaatgaaagtgtataggtcagtgcccagcggctgccggattggacaatgaggaacccggccagatttccaatgatgatcaaaccaatcacaattgcgataagttctttggtgcgatgatcaattttgcctttggaggttttaacgatccataaaataacaacagacgtaaataaaacgttaatgacatcaccgaacatcatggtgaccacctcaaatcgtgcgagccaactcgttgtcgttgcaagtggcttgttaacctgacatgcgagctaagttcctagtaaaagtatcgaacggcgccacgatccttttcctagcgttaatctactgccaattcacactagacgtcaactattgatgcttcttctttcgcctggagatcatcaaatcattttacccgttcaaccacctgctgtatcgcctccgcaaacgcttggggtggggtgatgttcaactcatgcccgcctgctagaacctcaagttgactttgcggcattaaccggttcaagcgcttggctgcaccgcgattagcccagtcgcgagacccgtataagatcgtggtcgggacggcgacgtttgccaactttgcccttaaatcaagttgcatcagcgaatcagtcaaggtacgtacttgcgatttggtaacacctagatcagcgaatgccgaatctggttgaaatcgaaacatcgcatcttgcgccttcatcaataatcggtttggcggtgagtattgcggtgcgctaactaaggccccgacaattttagtggctgggtggcaaagttgcattagcgttaaaacagcacccaaagacagaccgcacaaaataaccggggtttgattcttttgtagatcccttgccagtttgtcattgagcatcgacaatgtcagcgagtcgtttggcgttagtccggcaaatacatcaaacgtgcgactgggcacccgtaactgcttttgaaccggttgccaaacatcggcagactgccctaagccctgaactaagataatttccatatgccctccgtcagtagtgatattaggatcacttttgtataatagttctaatctacctgatgattgacactttgtctgccccgcgcgccccattaagttccctgagtggtaggtaaaaagatccctgcttccgttttcgggataggtgcatgcaaaaagataggcaggttatcagcagaggcaggttgtttcctccgattactgtgccggcttccgcaccataacaagttcccgaatcgtgccaaatttcgtcgcatcttcaaggatcgtcttagtttcaatgaagccaaaacggcggtaaaatgcttgcgccgcgcggttgttatcaagtacgcgcacatagtcattcgtataagtcacatcaagttccttgagcgcggcgttgagcaagcgttcgccaacatgctgccgctgaaacgctggcaaaacataaatcgagtagagctcgccccactcagcacgttctgccatgcgcgctggtccataactgcaaacacccacaatgccggcaatgtcgtcaattgctaggaacgtgttttgccagcggcgctcaggatgccagctggccggactcagttgtttcaaaaagctcgcaggcatcagattgcgataagctacctgccaggtaacgtaatagacccgccgaaccgcattaaagtcgctttttaaagtcgctttttgaatctgaatcatgaccagcgcctccaattgtcccgtcacgatcagtgaacacgatcttaatcggcatcacatcatcaccgtcatttcgttaaatacagatctcgaaaccgattaatttcagctgctgataattgcaacccctcatataaatattgatcaaaagagccaaaatgttctgtcaccacctggaaaaaacgctgcaaatacgctgcatccaccgttaacgcttcgccaatggcctgtagtttctgctcgccaaacccttgcttttttaagccagcgagaatttcttcgttggcttttttacgttcctgattagtccgcagataatccgccatgatgtcttgatcagatacaccgaggatttctaaaataatcgcagcgccaactccggtccgatccttgccggcaaaacagtgaaaaatcgttggccgatctggcaccaataacgcttgaatcaatgcgcgataaccagtttgagccgaactgcttactgccagctgctcatacgttgccaacatattttcgcggacactgccttgctcggtaatcatacggccgagactggcattattggcggtggcgtcttttaaaatgtccaacactgtataatcggcgcccggccacacggtatccggaaactgggcacgctcatcggcactgcgcatgtcaacaatctgcttgatgcctagatctttagctaaataatgttcctgcgcttcatccagttcaaacaactgaccggaacgataaatcaagtcagctttaaccgcttgcccattcgcattccgatacccgccaagtgaccgaaaattcgtaatcttttccatttcaaatccgccctttcactgtgacgccaaccgatactagtttcaactcatgcagaacagtgctactgccgctgcggaaacttttccaatcgataaagctgttgatcatccaccgtcgcatccccatttttaaacgtgtaacccatgtggcggtaaaagttcacagcagtaatcgaagcgggaatttcaacccgatgtgcctttttaaaatagggatcatgttccaatgtctgaatgatcaattttccaataccacgcttttgataagctggcagcacgaaaatgtcaaaaaagctaaattccgtctcactgccccagtaaggtccgatggcgccggtgcctacaattttatccgcatcacacactaagtaaaaatgcgtctgcttggccttttcaatgaagaaagtcggattcattcgctgaatacttgcctctaagtaagcttgcgagtaatccgcgcgatttgagattctcagcgtctgggcaacaaccgcggccacttcttgggcatcttccgaccgaaaccgcctgatctttagcatactgccatccccctccagaaacctgacgtgtccatgcgccccttgtatccgcttaatcctgatccggttcagacgccaagcaagcagccggcaactgtaaattgtgccagtcagtttcgtgatagtcttccataaattgctcgatatactggcaagcataaatatccaacagccgccgtccaccttctgtcaggtacaccagaagggacttttggctggtaaagctgccaattaaatcagttccatacagttgcccaagtgcctgattaagatcggctgacaacccgttcatcatcacgcgcggtcgtttacccaactgaatcagctgataaaagatcatcgcttgcgactcttgggaaaacgtggcatagctgtcatcgatttgaaaggttgtccgatggtgatgcccatattttaccagtgacaagacaaaaaaatcccgatagcaaaaggtcagccatggtgccgtcttcaggaacgccgtcaaatcagccgtcaattgttcctgtgagcgcaaaacaaatgtcggcactttttgaaacccgctgaaagaacgatgattgctgacccgaatcggcaaatattggtcctgcgaatggccaagaatcacgtacatggactggcttttacgcgctcgatagaaactaatcatatgatccccagaatctaatgcctgggcaatggccgctttaacctgcaactcaagcttttcactcatctgcatcagctcacctcgctttcaaaatcccggttgctactaacttaacacaaggattgactagctggtgacgattaatgaaaagttatggttgctagcggcgttctgatgccaaaagtgcaacgttcttcggccaacaagtcttcaactgcctgattgacaacgggatcatcactggcaaaaggttggacctgccggctgtgaagatctattaactcgtacagaaaaagtctccgcaattggagactttttcttcggcatcaataaatactgctacatcaaagcggatacaccacatgaaaagactcaagcacaatccgcgccgtttccgggtcaaactgcttcccttctgccgcgtattcgtttttgaagaatgccagatggacttcgcgccaatatgccaggctccgatcgccttcaccttcgcgataagcgtgatcggcactgacagctaaaaagggctgcacttcaaccgcatctgtatacgtcacacaaaccggttcatctgcaccatttaaaatcacgtcataagcgccaacctgaggcaatggttcatctgctgcgtacaaatcccgcgcactggccgttgccgtttttttgcctgcaaggactaacgccgccaacttatctgcttcagcgccgaattgataggcactttgtaaagtggttgttgtcggcaggttcaaagcctgcttagcctccgtaaaataagcttctggtgtcatcacataaccctttctgttcatattctttgacgaatcttcacactcatttgtgatatggactgccgatattaatcataaaggcccggtaaatctgttccattagtactaaccgcattagctgatgcggcatggtcagcttgccgaaactaagcgtatcattggcccgcttcatcacggctggtgccaagccaagcgaaccgccgatcacgaaggtaatatccgaatgcccgtatgtaccaagatcggcaatttctttggcaaaaacttcggaaggtcgctgtttgccttcaatggccaaggcgatcacccattctttgtctttaatcttatgtaaaatccgctcgccttccttggctttcacatccgccatttcggcttcggaaagattctctggcgccttttcatcggccacctcgacaatcttgacttttgcgaatttgtccattcgttttaaatactccgcaataccgtcgcgaaaatacttctctttcagcttacccacaccaatgatcttaatgttcatacaactcagccctttatcacgtcattaatcaaccggcaacttatccttttcaagtataccagacgttttgcggcgtttgcctattgtcatcgttcggtttttagcgcaaaatatacaagttgaggttttttcaaatgaggtaaattgatgattgttattcagcgtctgatcaaagatcgggtcctgcagatcaccgccttgttggtcgtcataagtttattcatcggacggcctaaagcaagcgacataagttttgccacattatggtcaattcttgccatgatgacggtgattcaaatcttcgaacacctacatattcttgattactgggcttatcggttaacttcgcgagcaaacaatacgcgtcagttaacatggtggtttatttttctggcgatttttgccagtatgtttctttccaatgacgtgacggttttaaccttggtgccgttatatctgcgggtagccaagaaataccaactgccggaaattcttccagtaaccttgatcgggatggctgccaattttggtagcgccttcacgccatttggcaatacgcacaatatcttcttgatgcaccaattcgaaatcgatctccaaaagttctttagttggtccattccgctgttggggtgcagtttcctggtgttagtgctattgagtttattcttgcgtaatgtcccagtgccaaaagtaccgactgaacatattcacatccagatgcgtccgaccctgtttgccattgccgttgcgtgtgtggtttttgccggcgtcattggtgttgttccggcttggctgggtgcaattctagccattgggttgtccgtagcgctggatcctaaagacatgaaagatgttgattatgcggtcgtgctcacgtttgccggcttcttcattatcgtcagtgtagtgcgtcaaattccttgggtgacacattttctgtctagtcttatcaactctgaaccgtctgtttatttcagcagcatcatcacaagccaggcaatctccaatgtgccgtcaacagttcttttagcgcggttcactggctatgttgaagccttgttctacggctccaacatcggcggcgtcggaacgctggttggttcaatggcgaatttgcttgtcttcaaacaatacatgatctatggcagccggccgcacgcgcgcttttttgtcggctttacaatcttcaacttaattggtttattgattctcggctgtgcgggctactggctgaccattcgctaaaatagatgataccgtgacactaggtaaccatagtgtgcactggaaaaaagtctttgggcacttacataataaataacacatgaaatgtatgcgttttcattgcttttccccaagaacgtgctagaattaggatttgctaaagaacgaagcgcatttaatccgcacgatggcgtcagacaaagttttgtctggcgtccttcatttccgcatatgaagcggttcgttcgcggactcaggaggaagataaccatgaagcgcaggacgttgttttcgatcatcgtcgtcacgctgaccgcaggatgttttaccttattctacggcatgcatagtatgtggactgatacccaatcagcccaagccgttcaagctgccaccgaagaagttgacacattattcaaggataaggcacaccaattaccggcagaccagcttagtcaagaaaagatcgaagcggtcgcgaccaagttacatgcagcgcggcaaaagctcacggaacctgaatacgccgccaaacttgccagtgcccaagctgatgtcgatgctgccaaacatatgctaaccgttaaaaaagcggttgcacaaaccaccactaacttatccgacttaaataccttaacaagcgattcacagcaggccttatccgaactggccactcaaaagcctgagtttgttcaggcctatcaaaaacgcgtggcacagttatccgatcaggaagcggcggttgcaaaaattgccagcttatttgatgatcccgacttcaaggagccaaaagtcggtcttagtgctgcccaagtgcaaaccgctttggctgcccttgaacatgtgaataatcaacagtttgccgatcaaatgctgccaatcatcgccaccgcccaacaagcagcaaccgatgatcagacaacgagtgaagccagttcatctgaatcatcaacatcaggcgaatcaagttccgcctcgcgtgcaagcacgagtagcacaccgtcagcatccaccagcagtcaggaatcggcatcttcatcagcttctaataacgaatctgaacaatgtcaaagcgtgccaagcaactcagctgccagttcggctagttcctcaggccagttgccataaaatcgtatcaaaatcaaaaagccggataccagcgcgaccaaattgtcaccgcgccgatacccggctttttttcgttgtcatgatcacaggctggatcacttgtatgccacttctgctatggcctatgacggacagcatgcagaacgtcactaagctgctagtttagtcaccagttgcgttagataatcgataaatcctaagtaatccgcaatagcaacattttcgtttggaccatgcgcggccgagttagcattaccgatgccacaggaaatgatcggcgcatgattaatatcataaaaatatttcattggcccgctgccaggggagtttaactcaacttggacatcatcatcgccataagtgtcacgcgccaatgctactgctgtttgcacgcatgggtcgtcaggatcggtgcgaaatggcggttcgccgagaaagtccgagacctcaatatccgcgtagccgcctgctatgagtgcggctttgaccagtcgcaccgtctcggctggcgtctggtccggaaccagccgcagatcaatcttggccaaagctgtatgcggtagaatcgttttgccaatgcccggaccttcataaccgcttgaaagtccgttaatggtcatgctagggcgattgtacaaggcttctttaatctgatcgtctggcaccgtagccggacgggtgatcccataattcttggcaaaggctgcataatcaaagtcagcttggttaatgagttgcttttgggtcgccgttaaaggtttgatcgcatcaagaaaatgcggaatagtgatttcatctcgagcattcttcaaagttgccagcgcctgaaccaaccgccatgccggattctccgtcaccgcgccgaaactggaatgaagatcgaaatcagcagtcttgacactcatctgaaatgcaacgccgcctttgacacccaaagagatttgaaatttaccttgctcatttcgtccgcctgattcccacaagcaaaagtcagcagcaagcagatcggcatattgagtcaataggtcatcaagatggggactgccttgctcttctccgccttcaaccagaaacttaatcgtacatggcaacccgccttgtgcttgcaaccgggcaaccgctgccagtcgcgctgctaattcacctttatcatcattgatgccgcgtgcatagagatgagtggcggttattttcagttcaaacggatcacttttccaaagctgcaacggctcggctggctggacatcgtagtggttatagaagagtaatgtcggggcctccgctgtttgggcgggaaacactgcatacactgccggattggcaccatccgtctgtagaattcgactggtggtggcacctaggtcagtaaattgttgctttaaaaaggctgcggtttcgggaatctgattttcagccgccagtgaaacggactgcagtcgaagatattgagttaaaaagtcttgcataggaagcgtcatcgtgacacctgctttctggttaatttatttgaagtatgcatagcggtattcagccggttgcaacatgctgtaatgcaagccgccaactttcgtgttaatcaggcggctgttggcactttgataaacaggaatgtaaccggccacgtcaattacccgggcattggcagcaagttcttgttgatagcgtgcggttgcggtttggccattagtatcgttcaccttattcattaaagttgtatactcgtgatcgctaaatttcgaaaagtttgaaatattatcagcagtggcggtgtttagataatctgaggggtcttgaatcgttgaattccagctcatcaagacggcatcgaatttgccattcagtgatcgctgaatccgcgtcattttcggtaagctattcacggtaactttgagttgcggcagtactttggtgagctggctttgtaaatattcgcccacttgtttatcggtaccaacatcggaagtgagaatcgtaaagctgatgctgtcggtatgaagctccttcaaagctgctttgagataggcctttgccttagtcggtgaataggttagcggtgttttggcgtcgctggtgaaatctttacctgtcgtcggattggttgctaatcctttaggggcaaatgccttagctggttgcgagccatcttgcaagactttgctggtgagggcttggcgatccaaggccgcggaaatggcacgccgtaagttgacgttgttcagttgcggattcttggtgttgagttgcaggtaattcatatttgcagcaggcgttttgctcagtgccggattgtccgcttctttttggatcaagttgcctgataacggtgcatcatccagcttgcctgtagcgaaaagattatcaacggtactggaatctttcaaaacattgacgtgtacatgattgattttcaccgacttagccgcataaaaattcgggtctttgacataattccaactgtcactggtcgtgtcaaaatgcttaattttataagcgccattggtcacaattttgtcggcagcagtgccaaacttcttgccgtaacgcttaacggcagcttcattggttggataataaccggtcatctgactggaaaaataaggggttggctggctcaactgaatcttgagtacgtacttactaggtgcggaaacgcccaaagtatccggtgacttttttccagcgacaatatcctgataattcgcgatcgcatcgtattgatacgcgaattcggttttagtcttgggatcaacaatacgcttgagagaataaacaaaatccttggcggtcacaggtgtcccatcgctccatttgacatcgcgccgtaacgtcagcgtgtaggtcttgccattgttggttggcttaacaacctttgtggccattgccggaatgattttgccggattgatcgtgatcataaagcggcgtcatgatctgctgaaggatcccgccgctggttgcatcaaccgcgtgggccggatcaagcgaactggcttccgtgctgactgcaacgttaagtgttcgctggttggttgctgcttttgctgattggccgcatgcggctaaaaggatggtgacgcctaggagcatgaatcccagtgagaattgctttttcattttgtacacctcgtgaaagtatttttggtggtggaacttggcacagacgaaggaggcgcgcctgtgcggatggtgaggcttggggtagctgggtgcctttggataggggcctttcgtttgcgggaaagaactcgcgggaacggagggggttctattttgggcacttggttggttggggattactttctataacgcgctcgcagtcgcagcaatctacatgtaaggacctctagcctaaatggccaaagcccagccatttaggctagaggccacttacactccgattgctaagcgctcctgctcgcgctcacacaaaaaaaccgcccataacaaacttcttgttaaggacggtttcccgcggtgccaccttagtttgatcatgagactgcgcctaggtattgtgtcatttggcagtttatgatcacgcttagcccggggccaacaccccggcgacaactgacgtatgccaacacgtttccccgtactcgcggtgctttcgggggaaccctcagtggtccatttactgacttgcgttcggccggactctcagcaacgccggctctctgtgcgtgcaccatcagcttgatctccacttcaaaggtttgcatgaacggttatttgattacttgcaactctaaccgtttgtcaggttatttgtcaagcgatatttaactaaaaagcctgacgaactttttagctaaagcgccagacaacaaaatattgaaaaaatttttttaaatttagacaacgttaataaagtcaagggctcgcaagttttgcttcaccttaccaaacttgcattcaactagtaaaccccttatattacaactatattaatgtgtaacaaaaaagaaccatttcgtgacctgtttgcaatggtcttgttaagtccagcccgtaccattaggatattggaggtggcatcaatgaagcgaaaacatattttccaagtcttggtcggcaccttgattgcagggtacttgaccgttttctatgggatgcggaatacgatcgatacctcatttacacaacatgccgtccaagcggcaacggaacaaactaaccaactatacacatccacgaaacgcgcctttccagccaaaaacctatctaagaatgcagtgacatctacgcaatccaagcttgagcaattagctcagaatgtggatgatcgcgatcagaagaaagttgtcctcaaagataaacaggacgctgacgctgccagccatatgctgacgattgaagaaaccgtaaaaacacaaaacggtaatctggctcagattgctgaagacggttcccgtgccaacgcagcttacaaagcaatcgcgaataccaaacctgaatttgcggctgactaccaacaacaagtcaatcagctttacaagaagtcactggccattgcccaaattcaaaagttataccaagaccagaatatgcaacatccaaaggcaaacctcagcagcgacagcattgatcttgccgtcaatgccgtcgaaaatgttgagaatcaggattttgccaaaaacgttcttcccctagttcaagtagcgagaaattcccaagaaagtaacgactcggatgttgcgatgaatcaaaaaggtgcaagcagtcagagccaacaaactggtcgggaatcggctgccagtgacgatgaaccagctagtggcgcgggaacaacatccacaccttcaagtcaaaagacaccatccagcatctccagccagcaaccagctgaatcaagccagccgtcctcaagcaacccagctggcagcagcacttcagcttctgatgatcaaggtcagtcatcatcaacccctgcttcaacgggtagcattgaacccctgacaaccgtgcttagtggcggcctttacaaaacttacgatgatgctgtcgccgctattaaggttcaaggcaaatctgttgacgacatgaccgtcaagtcagtcaccatgagtgatggctcttaccagtggacttgggggccaaacggtgatagcggcagtcaaactagcagcagtagtgccgccgcaagtagcagtaccggtgcttcaagcagttccagtcgtactgcctcttcaccaagttccaatgccaatcaagcttctagtcaagcaaattaattgatcattcgttttcataaaaatgctgtcatctgacttggatgacggcatttttcttttgtctggatccatcaattagcagtccagacaagggatttaattgctctgttatccttatgtggcttcccatatgcccactaagcaatgtcttttgactcactaggaattgtcgggcgctcccgagtcactatcccattactatcaaagttttacccgttacagtctagatcttaattatgttttgtagcagcttagcaacccttgatgacataaaatcggtcaccttactgcaaaaagctacttgcaccaaaaaaaggtccaatcagatgcgcttatatcgcgcgtatctgattggaccctgaaatctcttgatcttaaattgttaattaagcacgtgcttctgcgcgaaccggatcaaccaacgcctgccgatgcaagccattacgtgcccgcagcgcatataaaatggtgaccgtatcgacgacttcttgcaacatggcgccaataatcgttggaatgacgccgaagctggcaatgagcatcaatccggtacaaatcgcaatcccgatcagcactgactgcttggcaatgaccatggtttccttggcgatcaaggttgctgctgccacttttgctagatcatcgcgtaacaccaccgcatccgctgactcactggcagccgttgcgccatgtgcacccatggcaatcccaacatcggcaatcgccagcgatggtgcatcgttgaccccgtcacccaccatgacaacgggacgatcatccttaggcacattgtccagcacttcaatcttttgctgcggcaattgctcagcatacacttggtcaataccgacttcttgagcgaccttatcggcaatggattgttggtcaccagagatcatgatcaagttggcatcgtttaattcgtgcaatttggtcatggtttcttttgcttcaggccgaatttggtcggaaaaagtaatggcaccggcatattggccatcgacattgacataaaccgccgttgtatccaaagtgtcttttgcatcggcgaactcagccttgccgactttaaccttatgcccgtcaacggttgcataaacaccgaaactagttgcttcactgacctcgcttgccggcagccgatctgctgctggcactgcgtctgtcaacgagcgcgccaagatatgggtcgattggccttctgcactggcagctagattcaaaagctcatcttgggaaaaaccggcttgcggtaaaactgtcgcgactttcaaaataccacgggtgacggttccggttttatcaaaagcgaaagtccgagcgtcactcaatttttcaagggtagtccccgacttcacaataatcccgttacggctattgcgactcatacccgaaaccatggcaatcggtgccgcaagaatcaatggacaaggcgatgcgacaaccagtacctgcgcaaaccgaaccgggtcaccagataagaaccaacccaatccggcaatgacataagcaactaacgtaaatggtaccgcataccggtctgccatccggacgaaatgagccggacgagcttcggattccttaacaagtttaatgattccctgatattgactgtcttctgctcgctgcgtaactttaacggttaatgccgaatccccgttgatcgtcccagacatgatgtcactacctgcgtttttggcaactggtttggattcaccggtcaaactggcttcatccaccaaactctcgccttccaaaaccgtaccatcgactggaacaacttcttgaggcttaaccaaaatcgtctcgcccacttgaacggcatcaacgtcaacatcttcaacgtggccatcaaccaaccgatgagctgtcgttggtgcgttttctaataactgcttcagttcactgctggcttttgtcgcagcataactttccaaggcgtccccaccagtcagcatcagcaaaacaatcatcgctgcccaatactgactgactgccaaagtggcgactaccgccgtaattgctaacaaatcaaccccgaaattacctgaacgaatggtcttgaccatgccgccgaacataatcaaagcaataattgaccccatgactgtaatcagtccctgagcaatcaatggctgttttaatatgaacgcaaagaccagcgccacagcactcacaacaagcaccatcataagctgccagttcttcttcattgttgccactcccttttcctaagtaccccaattataaccattacaatttaaaaatgcaaccctttttagaacgaatataatctggacgttcaaatcctgtaaccgatataattcagtctaggctaactcagtaaacgatgaggatagcaagtgttagctcggagctgttttctaggccttcacctagacaattctcttttcggttatcctaaatgtttaacttctattatacgcttttacagcgaaacgaatcatcaatttgaacttatttcctgttttcagtgacctcatctgctctgaagaagctgctactgctgtcactttgttcgtcaggatcaaatgaccggtagctagttattgctaagcgcccctgctcacgctcgaaaaagagccggatcagtttcccgatccggctcctcaaggtattcatactagacaaacagatccgattcaatcaatcgtaatctgatgcccatcctgctgctcggctgccatctttggtaaatcaatggtcaaaacgccatcactgactttagcactaatcttaccttcatcaacgcttgtcaaccgatagctgcggctcatgcggccatagctgcgttcagacattagcatattgccctccttgtctgaatgatcagcctgttcctcatgtttaactgcaatgctgagaacatcatggtcatagcttaaattgatattttgcttctcgatcccaggtacatcaaccttcacaacatatgactcgtcattttcctgaatatccgttttcagcaggcgactgttgtcaaccccacgagttggcgtaaagctgtcaaaaatatgccgtcccaaatcattgaagaatggatcattcaaccaatcattccgccgcataagatcattagccatcatcgaaaacttcctttcattttgaaggttacgacttcctcttccgaacatctttagtataacacaaaaattagcactcgtcatgttagagtgctaatttgaattttctgctattttgattgtttgtcgttttacaggttcagcggattatgatcgtacattaacaaatcttgccgcctagcgatttcatttcctcacggcgtttgtcatcattttgcggtgttgaagttacctgattaagggtaacggcaccgtctaaaataccactatcatcacgcaaggctaacgaagcatttttaaaatcaagcgtcaggccgcttccgaaataatcggtttccagatcgcctgtggtcagcttcaagcccgcatcattttccagtggcaatgcatagtcttggtcgtcctgattggtcacaacaatttggtacttattgccaatagcacaggagccgcctagtttcgaatacttacttgagccatcatctaatgccagaaacaaatgttgatcctttgcaacgtgctcgttcaagtacgtcactgcagctggtttaatcgtgattttcatgacggaccatcctttcaaatacattgtgcacaattcttttacctatttcatcgtaaccacttccgcagccgaagtcaaatgttaagtttttcgcagcaaacaacaggttgtccacaccggttatccacatgttcaaaactcaaggcccaaaatatagtattaagtatgcccattgacactaaatagacgattcaaaaaattcaagtaaaaaatttttcgacaccgttcatccacagtttttaattgttcgatttcacaaagttcagccgcttaatcccgctccagcagccgggaacaaacgttttgtcacaagtcaaaaaagtttatccacaagttatccccagtttggtggacaacttactcacacccggaaatcttagttatgaacagtatccacagagttatccacaggctagggcatctttttacgcaaaagttacccactcttgacaaatcttttacttgaacttttccacagattagcgctaaaactttcgtgaaattctgaagaaaccgctttcgactaatttcgctgaaagcgcaaaagagcctcgatcaaaagacgaatcttttaatcgaggctctcatcatttaattcttcaaatcacttgttgtctgtgaaagttttatagatacggtttgctgctcacctttacgatacaaggtcagtttgacggtgtcgccgactttatgcttataaagttgcgtgtgtagcgcagcggtattggagacgctgacaccatccagcgcagtgatgacatcatactgtttcaatcctgccgccttggcactgctgccactggtaaagccgccgacaacgaccccgccggtaacactttcaggtaacttcaaaacggatttttgctgactggcagaaacggtggacaagtcgcgcacttcaatgcctagcgctggccgaacaactttaccattttcgaccaattgattgatgatcgaaacgacttcatcacttggaatcgcgaagcccatcccttcaatcgttgctccttcagaactgctgctcgagcttccggatagcttcattgaattaattccgataacctgacctgacagattgatcaacgggccacctgagttccctgagttgatcgcggcatccgtttgaataaccgttgcctgtccggtggtgttaccactgctatcggtcacatcaacggtacgactcttcgcactgacaatcccttgcgtcacactggtagcatactgtgagcccagcggcgacccgattgccaagacagtttgcccggcttcaatcttgctagagtcgccaaagctggcaactgtgttaaccttactgccatcaattgtcaaaaccgccaagtcagacgttgaatcggttccgactaaactggctgtcagtttggttccatcgctcaaaataacttcgagcttatccgaaccgctcaccacatggttattggtgacaatataagccttgccatctttcttttgataaataacaccagaaccttcgctggcctcttcaagacttgatgaactactgctcgaactactgttattttggttatcctggccaaaaatgccttcaagcccgccaaaagtatccagcccatcgctgttactttcagccttttgcatgttaacaactgagacgactgcgcctttaacctttgcaaaagcctgttctgaagcactgctttgattgactgaaacattggaaatcttggtcgttccggctttaccagaggtgtcggtcacgccaaggcttgtcgtatggttgatcgcccaataggcagtaccgccaccaacaccgccaccaatcaaggcagccacaacagcaacaattgcggtctgcttcaaaccattcttcttcggtttttccgccgaccgttgcggcttctgatcctgtggcgtctcctgaaagttatgacttccgttatccataacggtttcctccttacgggcattctaactcaccctgtttacacagattattgtaagtgacgattttgacgaaactatgaacaacatcgtattttttagtgagcgcgaaccggcgcgtttaggagtcggagtgtaagtggccgacccgggcttggtcattgcgactgaggtccttacacgcagactcctgcgccggtgagcgcgttatggtgagcgtgagccagcgcttaggagtcggagtgtaagcggccttgggcgtaatggccgcactttggccattgcgaccaaggtccttacacgcagactcctgcgctggcgaacgcgttatgggcataaaccagaacataagcggccttagacgtaatggccgcactttggccattgcgaccaaggtccttacacgcagacttctgcgctggcgaacgcgttatgggcataaaccagaacacaagcgcctcgaacgtaatgacccgagcttacccattgcgaccaaggtccttacatgcagactcccacaccagtaaacgcgttacaacgagcgcaaactacgacgaacaccctccccaacccacaaaaaaaccggccagcttacatgctcccatctaagtcgtccgttttttcacactgctaaaactgctttcaaaccgcttcacacaacaaacaatgggtcggcaactgccgggtcagtgtcataaatatgaaagtcatgatccaccgccagaccttgttgtgccaacaacgacgccacggttaaatgcgccagtggcttattgttgttatgcggtgataaatgccccaaataaatccgcttcgtccgcaaaccgatgacatccatcaaagcatccgcaccatcctcattggacaggtgcccttgatcgcttaaaatccgttgcttcaacggccacggatacggacctgtccgcaacatttcaaggtcgtgattgcattccatcacatacgcatcggcatcgcgaatcgtcccggcaacccgatctgaaacgtagcccgtgtcggttaggatagtgaaggccttgccgtcatgatgaaattggtaaaactgaggcgcggcagcatcatgcgaaacgccaaaactttccacatctaaatcacctaacgtcaaagttgtccccatatcaaacaaccgcagctgtgcttcaggaattttgcccacactttttggtaaagctgcaaacgtcttggcattcgcataaacgttgagctgcggataacgtcgcgccaacacgcctacaccacgcacatgatcgctatgttcatgcgtgataaaaacactgtcaacatcggttagatctctgccgatgctcttcatcagcgcttcaattttcttgcctgataaaccggcatccactaacaccttgtgaccaggcgtttcaatataggttgcgttaccagagctgctgctggcaaggacactgacacgcatcccaaaatcttcgcccacgatcaccatctccaaactttttaccatttagtcaactgcctgatctaggcaatcggctctcactgccgtccattctaccacttaactgtcattacggtttttcataactgttcgagtaatcgcattgacacgttttaccgtgacattcccggtcgagcgattcttgacgccaatgtaccaagccgggacataaaccgtactgccttttgcatcaagcaggtaactataagccaactgtgtggacacaatcgccgaattattagggatatcattgtcacgatacaaagcaatgacagcatcctgttcactcatcaagcttaaatgatcccgcaaaatgtttaatttggtcagataagtctgcgtataactaaccagacgattatcggatacatgcaatgtcactgccgcacgccgatcgtaaatcagtccggcttggggatgctgggcaaacaccacgcgttcgtcattagagagcgccggtgcatactcatactccttgccatggtagacattgtttttaacaaaagtcttcatctggcgcagttcctgattcttttttaacgttatgggcacatccagattggcttgcaattcctgataatcgccttcgctaatggaaacctgctgcttcaccaggttcgtgcgtgccgcggttaatgctgagttggcttgacttgcaagataatcgcctttgggtgtctttttgcttaaacgcggcagcttaatttgatcgcgcgtaatgtccgtgatggttgccgcatcgccacttttaatcgttgccaagtcaacctgctgcgcctgaaaatagctaattcccaggaaaatattcaggccgacaaacacaactagaaagatccattcaatccgtcgaaaatccacaaaatcgcctccctcagcaagcagtttattagcttgtcagttagttaaagatccgttattgcgttggctcagattcgctcgcactactatcatcattgctcggcgtcgcagtctggccgctagcggcattggcagacgcatcgctactatgattcagccagctttgataatcccgatattcgcctttcatctcaacataataagtcggctgcaaatcgatcacttgctgatcattgctactaccggtccactggtaaccaatcaggatatccgtaatctgactggcacgatagcccgcagccactagctgattcaccacggtagcagttgccggtaaggtttgtgccggttgatttgtaggaatcggcaccgtcagattggtattagagaaattaatctcctgtgatgtctgcgtataccgaacagtaacatcacctttttgatccacattaaagatcgggaacccttgcgcataggttttataaaccacttcgccacggctggcatcatattgaaaataccgcatactagccaggtttgtcatctgcaaatcgctaagtcctttgaaggtcgcgtgcaggaaattagttaatccactgtcaggaaatgttgccgtatagttttcaaattcaatcgcaccggttcccgaatcagcggtcattcgtcgagtcgaacccgcagtataaagcgtgctatcaccaatttcacgtgcatcgacattgctggcggttttcgatggcattaacaaggagacataataattggcactttgttgatccatcagataagcatatggcggcagtttgattggctgcgtaaagaacgcaacttcgtgattgcctaaccgcttttcttcaattggaaaagcgcgggtaacctgggtcgtcacaagcttttggagctgatcctgtgagacgttggctaacttggcttcgtaaactctccgcgtggcatcgttaattaaggtcagttttttaaccgcaccatctaaattcaccaaaacccgattaaagtgaaaatcggaggctttgatttgatcttgcttgctaaaaaaccactgttcaaattgtttaaaactcatgacgtcttgatagataagttgcaggctgccatcttgttcaaggtaagtttcataattagccggcgagacttttcccaccgctttaacctgcgtcatatgccaatccgccattgcttgttgaacttcatggtcgatattggcattggctttaaatagcagctgcttttgaccacgatgcgtgtaataaacttggttaggcaggtaaacgttgccttccatttttttaacattcggatcgttttcggttgttacctgcacgttcgatgtacttcgacgctccagccgcgatggatttcgccaaatcaatgacgtaaagacgaggcttaaaataaccatggcgatcagactcacgcgcaaaatccaactactaagcttcatcccagtcatctcctccatcggtaatcggttcgtatggcagtgagatatagaatgtgctgccacggccttcttgtgaatcgacccaaatgcggccatgtaaggcttcaacgacttcttttgaaatcgccaagcctagaccggttccgccttgtttgcgggagcgcgccttatcaacgcgatagaagcgatcaaaaattttacccagatcctgacgcggaattcctagcccttgatcactgatggacaaaatcacgtgatcgtgcatctggaacaaccgtgctgtgatcacgccgccatccggactatatttaatcgcgttattcatgatgttatcaatcacttgcatgaacttgtctgtatcgatttcaacccaaagatcttcgtgggtaatttcccgcttaatcgaataacgcttcttttggccatccggctgtggcaacggttgtgcagtccgcgcctcaccggtgtgttcgttatccgtcttgagcatcatgtcgaatcggtccagaacatagttgaagaactcatttaaattgacggtttcaaggttgaacttactggtaccggaatctaaacgcgacagactcagcaagtcgttaatcattcgaatcatccggtcagtttcctcttgcgtaacatttagaaactgcggtgccagcttaggatctttccacgcaccatcacttaacgcttcaatataactacgcactgaggtcaacggcgtgcgcaattcatgtgacacattggaaacaaattccttacgatcgcgatcaatcttttgctgctccgttacgtcatgcaaaaccgcgaccagtcccgaaataaagccggtttcgcgttggatcaagctaaaatcaacccgcaaaatcagatcatgatcaagttgctccgaaaaatccaacaacaattcagtctggtgctcaagtaagtcacgcaaagtataatccttggcgatattgagtaacttcaaaatcgaaacgccaataacatcctcatttttagtattgagaaaactcaacgcggtctgattaataatgatgacattaccgcgccgatcagtagcaatcacgccatcggtcatatgagccaacacgctatccaaccggcgccgttccgcttcggaggcttcttgggcttcttcaacacgcacacttagattattgacggcgactgcaagctggccaagttcatcctgcccgtaaattcgaacctgaccggaatagtccccacgcgccatccgaatcgcctgttttttcatttcgtcaattggccgggtgatcgcgcgactaatgacaatggaaagtaacgtacccaataagccagcgactaaactggaaatcagaaaaataccaacgattttattaatactatcgtaggcttgctccattgatgctgaaatggcaatcgcgccaatgaccgaattattgtcgccggttgcgttcggattcttaatcggtacaaccttgtaataagtcgatcctgtacgctcccgatattcatagccttcgtattgttggccagagtacaacgtgtttttaatgttggaattagctgacttttgcccaatattagtctgggcgttaatatcactgtcaccgcgaatcgttccttttgcgtcaatcacttgtagatcagccgaattggcaatatctgcctgactcaaggtgcttttaatatcgtcattggcattgtcggtatcggtgcgcaacaaatccgcggccagcttatcttgaatatagctgtccacgttaacactcgtcttgaactgttcaatattttgctgctctaaggtcttaacaaaataggccccgatcatttccaatgtcacgaccagcaaaagaataaagacgatcgcgattttaaagtgaattgactgaaagaagcgaatctttttattcaacagtggtgctcctaattattcagcgtcaggatttcgcaaataatagcctacgccgcgtcgggtcaccaaccactcaggatgggacggattgtcttcgatcttctcgcggaggcggcgaaccgtcacatccacagtccggacatcgccaaagtagtcatagccccaaactgtctgtagcagatgttcgcgggtcataacctgtcccaagtggcgggcaaggtaatgcagcaattcaaactcgcggtgggttaattcgatattctcaccgcgtttagataccgtatacgcgtccggatgaatcgttaaatcgccaacttccaattcacgattggcttcgtcttcctcactgccggcagcattggctgatgaggtacggcgcaagttagccttcacccgcgcaacaagttctcgattggaaaacggcttggtaacataatcatctgccccaagctccagtcctaacactttatcaatttcggaatccttcgccgtcagcataataatcggcgtgtcatgttctttacgaatttgtcgggcaacttcaagcccatcaattttcggtaacatcaaatcaagtaaaatcaaatcaggtgattctgattcaactttcttcaaggcttcttcgccatcatatgcagtgacgacatcatagccttctttatccaaattaaacttgacgatatcagagataggcttctcatcgtcaacgaccaagatttttttcgccatcatcggccctccttggtttaagatacacttctatagtataacggttttaaagcaagagcgcgagccggtgcgcttagaagtcggagtgtaagtggcctcagccgtgatggccgggctttggccattgcggttgaggtccttacacgcagacttctgcaccggggagcgcgtttaagcaagagcgcgagcaggagcggttagcaatcggagtgtaagtggcctcaagcctaaatggctgggctttggccatttaggcttgaggtccttacacgcagacttctgcaccggggagcgcgtttaggaaagtgtcaacccttcctcggtctactctttaagtgacttccgctacttcgatccgcctccgcgatggtagccccccagctcttgctttctatcccagaacccgaaacaaggaacttatcccaccgctacttaccgttagttaacaccccacgcatgaatttttggaggttattttatgtttttccaccacgatcatctgaagctctactatcaaaaaagcggccacggaccggcgattatattgctacatggcaacggtgaggatcatacccttttcgccgatttaatcacgtatctcgccccgcattatactgtgattgccttggacagtcgtgatcacggtcaaagttcggctacggagcaacttagttatgatgcgatgacgtcagacgtttcagctttaatcactgaattggagttagcccgaccgatcatactcggcttttctgatggtggcattattgccttgttgctggcaattcggcaccccgaacaagtcggcgctttgattgttgccggggcgaatctgacgcctcaaggtttacgctggtattcgcgcattctttttcgtattgccgctggtcatcggccatctcctaagttagccatgatgctccatgaaccgcaaatcaccccgcaaatgctgcataggatcaccgtgccaaccttagtgctagcgggcagccgcgacttgattacacgtaaagaaactttttcgattgccagttcgattcaaaatgccgaattgcatattctccccggcgaaaaccacaactcatatattcgcgataaccacaagctttggcaccttatcagaccgtttctggccggactgcaagcggtcgattaaaatgaattatttttgtatatttaacattttgcttgcatattcattccaatgagtatatattcaatccataatcattaatgaggagtgaactatatgcggggaatcaaacattgggcggtcgcgatcattgcgctgatcgctatgatcgtcggcttcaccagttatcagccggttccaacggcagctgccagcaaagacttagcggcgattcaaaaacgcggctatttagtcgttggtctgtccgccgactacgccccattggagttccacgccacgattaacggtgctgacaccatcgtcggcgcagatatttccatgtccaagcaaatcgctaaggacatgggcgtgaaactgcaaatcaaagaaatgaacttcacggcgctgatcggggctttaaaaaccggcaagattgatttgatcgtctccggtatgtccaaaacacctgaacgggaaaaagaggttaacttttcaaccccttacctgtatgaaacgcaagtcatggtcattcgcaaggccgataaagccaagtacaaatcgattgccgacttttccggaaaacgagtaggggcacaaaagcaaacgacgcaggaacagcttgccaagacccaactgcccggtgcaaaagtcacgagcctggataaagcaaatgatgtggttgcacaaatttcgtacaacaaattggacgccggggttttggctagtaccattgccgactcctatgttgcccggacaccgagtttaaccgtgattgacccgcattttgcgactgacaaagccccaactgccatcgccgtcagcaagcaatcgcctgccttgttaaaacaagtcaacaagacgatcagcaaagttaaaggcgccaaatacaaaagttatctgcaagccgcctacaaactacaggatcaggatcaaggcttctgggctaagtacggtaactactttatccgcggcgctatttatactttggtcttcgcggtcttaacagtcttattcggaactatcatcggcacgctgcttgccttgatgaaactcagtcgcaattggctggctaaagtggtggctaacatctacatcgagtttattcggggtacgccgttgttggttcaagcgttcatcgtcttcttcggtacgcagatcctcggtttagatctcagcgcatttgttgccggcgcgatcgccatggctatcaactccggcgcatacgttgctgaaatcattcgtggcgggatcaattccgtccctgtcggtcaaaccgaggcggctcggtctttgggtctgcaccaaagccaggcaatgcgatacgtcattttgccacaagcaatgaagaacatctggccggcattaggcaatgagttcgtcaccgatattaaggaaagctcggtcttgtccgttatcggtgccaccgaattaatgtttgaaggtaccgttgtgcaaggcgcctcgttcaaaccattcctaccactggtcgttgtcgccattctttacttcatcatgacgtttaccctatcacgactactacgcctgattgaaaaacggtttaattaacctttgctttagcacgcctgccataacgcgctcacatttattaagggaggatatattttcatgacagaaaaaattgtactagcctactcaggtggtcttgatacatccgttgcgattccttggctcatggacaagggttatgaagtgattgcggtcgtcttgaatgtcggtcaaccggatgcggattttgacgcgattcaacaaaaagcgcttaaagtcggtgccattgattcgattgtcattgacgcccaagacgagttcgccgatcactatgttgcgccggtcatcaaggccaatgcgttatacgaaggcgactatccgttagtatcagcgttgtcacgcccattaatcatcgagcatctggttaaaatcgcccacgcccaaaatgccaccgcaattgcgcacggttctacgggtaaaggcaacgatcaggttcgctttgaagccgcgattcacgccttggatcccgaaatgaaaatcgaagcaccgattcgtgattttcactggtcacgagaagaagaaattgattacgccaaagatcatcatgtgccagtcccaatcggcaaaaagtcaccgtactcaattgacgccaatctctggggccgtgctaacgaagccggaattctcgaaaatccttggaatcaggcgccggatgacgcatgggggatgaccgttgcccctgaagcagcgccggataaaccgacttttcttgatctaacctttcaacaaggggtcccagtagcattaaatggtaaccccatgccgctggctgccatgatcaaacaacttaatcaaatcgccggtgcaaatggcattggtcggattgataaaatcgaaaatcgtctcgttggcatcaaatcgcgtgaagtctacgaagcaccggctgcagcagtcatcatgacggcgcaccacgatctggaaaacctcacgcttgaacgcgacgtccaacatttcaagccaaccattgagaataaattgacgaatatgatttacgaagcccaatggatctcacctttattcgatgctttgatggctttcatcgataaaacccaagccgtcgtcaatggcaccgtcaagatgaaactttacaaaggcagtgccgtcccagtcgcgcgtcagtccactcacaactcactttacgatgaagacctggcaacctacaccagtgccgattcctttgatcaggaagcggccgcgggcttcatcaaactttggacgctgccgaccactgtctttgagcaagtcaaccatgttcactccgaggaaaagcaacatgactgataagctatggggcggccggttcaccgaaaaagccgcgcactgggttgatgcattcggcgcatccatcagttttgatcaacaaatggccaaagaggatcttgaaggatcgctagcccatgtcaaaatgctaggcaaaaccggcatcatcccgcaagccgatgccgacacgatcaccgctggcttacatcacctgcaaaaagaactggcagcaggcaaattgcattttaccgttgaaaatgaagatattcatctcaacatggaagccttactgacagccgaaatcgggccagtcgccggcaagctgcacacggctcgttcccgcaatgatcaggtagcgaccgccctccatctatggctcaaacatcgcctgcctgctattaaagaggccttgacgaacctgcaaaccgttctcgttggtcaggcgaaggcccacgccgccacgatcatgcctggttacacccacatgcagcacgcccagccaatcacctatggccattatttgttggcgtatttcgaaatgttccagcgcgactgggaacgtttcgactttacccaaaagcacaccgacatcttgccattaggcgcggctgcactggctggcacgacttttccgattgatcgcgaacttgtggctcaggaattaggcttcgatcagctgtatcacaacagtctggacgccgtatcggatcgcgactttgcactggaatttctcagtaacagcgcgattttgatgcagcatctgagtcgcatggccgaagaactgattttgtggtcaacatttgagtttaattacatcgaactcggcgatgacttttccaccggcagctcgattatgccgcaaaagaaaaacccggattttgccgagctgattcggggcaaaaccgggcgcgtatatggtgcgctgatggggctgctcaccaccatgaaggccattccgctggcgtacaacaaggatatgcaagaggataaggaaccgatttttgatgcttataacacgatccttggctccttgcatattttcaccggcatgcttagtgatctcacggtgcatgaacagcgcatggccgccgccacaacgcatgacttcagcaatgcaaccgaactggcagactacttggcaacaaagggcgttcctttccgccaagcccacgcaattgtcggcgagttagtgctaaaaggcatcaaaaccggcacggcgcttcaggaaatgccattaagcgaacttcaggaagccgcaccgcaaatccaagaagacgtctacgcagaactcacctcaaaagcagccgtcaatcgccgtacctcccttggtggaacagcggttagcaacgttttgaaagaagttgcccgcgatgagaaaatcattgccgatcatgaaaacgcggcaccttccatgtaagtaaagcaacgatatttgaagttatgcatcacgacaaaataaaatcggtcttagagtggcaagacgctctaagaccgattttgctttccttacgacatttgaatcaacaaggacacaacgacttcaatcattaccttgtgcgtttttgcaaactaaacgttgaccacggtttgattagcgttaacagatctgcgtcatcagccgcaacatggccaattaaattccgctggccatcatcgctaaatggtgtcaaaacaatttggaattcacctttatagcggccatacgcatcgttgacgatcacaatatcgccgcgtttgaagggttggccatggtcgtgggcgggaatactggccgtgctatacgtgatacgaggctgggtatcccgcagtaaatacgccgatgcatccccacgatataaatgcggcgcggcaaatgctattttttcttcaagcggcgtgatacttgccaacatttcggcatgcaagatcgggtatggcgccaggaaagtatcggcaacggttttgagttccgcttcagtcgcgaaggcattaccgatgatcacgtcatcaatcaagccggtcagacacaaatgcgttgtttgactggcaatgttgcgatggcgatcagactccattgtcggtaacccatcatgcagcggccaaggcccgattttaccgctggctgacgacacaaatgcggcggtatgcaatccatactcccggtactgctgggagtattcggtaaagatagcctcactcagacctgtgaacgcctgcggatagaagttatgacagccgattaggttatcgcggttaggatcataagccatgatgctcgcaagataattggtcccatggctcatattcaattcgatttttaagccatagggattgcgggtcatccgcgcttcttccgcgccggtgaagccttcatccagccgcagtccccaaacatgaagcgtttcaaaaaaactcagatcgtcatagctaatcttcagctccttgaacaacgccggattaatatcaacgatcgtcttaaacccaagctgattggcataatcgattgtctggcgaaacttagccagcagatcttcaccatcttcccccagcagttgcaagagtgaggtgaaaatgcgggtataaccatactgatgtgccagatcaagataggctttgttctcctcgaaactgctttgatccggataaagcgagatacctaatcgtttcatttcacaagaatcccttcttagttaaaatactgtgctgccatttgccgtgacatcttcttaaagcgatgtttgcgttgccagtttaataaaaatccggccgtgcgattgttggctttgccttttgcggttttgccttcaatgatttcagtgtaatccagctgcatctgctgatcaccgagatcgcgtaattgataatccacatgataatgatcgcggtcagtgtctagttcatacgcgtaacgctgattggcaatggcatgcgtaatcgtcagctttcccgtcatgccattcgcccatttcttctggtacgtgaacccatcaagactgcccaccagaacttctcgcccagtgtgcgccttgatgtccgcctgagccgagcgaatcagctgcccatacatgaacgccgccggaaccttgagtgtcatctgaattttcaactgaaaaccgcctttctaaaacaatttttcctataaccgtcaatcagcaagctgggctggtttaattcgattggctgctttaacaaatggtacatagattaagaagccgatgatcatattcacagcctgtagcacgactgctcgccagtccatggttgcaactaaagcatttaaaaatggcggcatcgaccagacaatctgattcttgatcggtgagaccaacccactcactaccgcgccataagcaatggaaaccatcactaccggcgccaaaataaacggaatgaagtaaataggatcaagcacaatcggcatcccaaacataaccggttcattgacattgaagaaccctggcgcaattgacagctttgcaactgcacgctgatcatcgcgctttgagaacatcagaatcgcaatcagcagtagcaaggttgaaccggcgccaccaatccaggcatataagtcaaatgaattgcgagtccacagatacggcagtgcttggcctttctgaaaggcattgatattcgccaactgcgccgttaaccagatactatcaagcaccggtcctaatacattggttccgtggatgccgaagaaccagaagacttgaaccaaaatcgtcataatcagcacggaaccgtaaccttgactcaaacttaacaaaggttcttgtaaaactttagcgataaattcaatcacggtcgtaccaaattgagtaaacagatagttgataatacccacgccgtacaaggcaaccgccgccggtacaatcccggtaaatgcattagcaacagccggtggaaccgaatccggcattttaatggtgatatgtttcttcatcaaccagatgtaaatagttgcggcaatcgcgcccatcagcataacggtgaagaaaccatacgccccgaagaacttgccaaagttgaagaatccccacatgctgacatctttaccggaaacaaccgctccggcatcggtcaatgtttttacggcaccttttgccagcccagccttcaacgtcatggtgaagttttgcggcaagctcataatgaaggtgcccaaggtgacgattcctgccgtcacaggttcaaccttgtactgcaccgcgagctgatagccaaacgtgaatgagaagattaagccaagaatagctaaggttccggtccagacaacagcgttaatgccgataagccactgcattgagttaacgaaaccggtccagccaaattgggtcggaatatcccgaatcaaagcgttcagcacggtggaaaccgcccctgccatcatggctggcatgatcgcaataaaagcatcacgtaaggccaccagccaccggattgatccgatacgcgctgcgattgggacaacatgtttattgagccaattgataagtccgttcatcttgtacactctccttgagttttaagcacgctggccgcttcttggcacaccagcgcataatgatttcatttgaaccaacttcggttttaactaccgattcaaatcgatattggtcgtatggtagtacaacgttagacccggataaacaaaataagttcgggaaaagttgaagactttgccgctagctagatagttgatcccgtctaagcacaggtgatcagtctgtgccgacatcgccatcaactcggcatactcggctggtaatggtcgtgattggatataattttccgttgtgcttccaaccatggcataggtgttacgcaaatacgtgaagatcgaacccgccgcaatctcagctgaaagatgtggcacaattgcttgcggaaaatacgattcttccaagtcgtacaattgcccttttaaatagcgcaaccgcacgacttgatagaccatatcgccgcggctgacattccctcgttgcgccaaggctgctgtcgcggggataagcgcaaacttaaccactttggaagtcagcggtccgcctttcaccatggctgtctgatcaaagcctatcgacatattgaggacagcatcggattgagccgaatgatcaatgacatagtacccgctaccttgaacccggcgaaccaacccatgggcaaataccacatccagtgccttccgaatcgtattgcggctggcttgataacgatccatcaacacctgttcagtcggtagcttaaccggatactgaccagccagaatatcttgaatgagttgttcggcaatatcgtgatacatcaaagtcctcctccaaacttaaagtgttcatttattttcaaacctatcagccacgggcagttgccattgcgcgctaacggcatgatccgcaacctgacaggttaatgagcacggcacaatgttctgaaagcgcttgtaaaatttgtacctacgaattataatatcacatgaaacggaaaacgattacattatttttaaaaaggagccgattttcatggcagaaaaaaagatcatgttagtttgtgcagctggtatgtcaaccagtatgttagtaacgcggatgcaaaaggccgccgaaaaagatggactttcggttcatatttttgctacagctgcctctgatgcagacaacaaactggaaagcgaaaaaccagatgtcttaatgttgggcccgcaagtccgttatcttgaaagtcagttcaaacgcgacctcgatattccggttagtgtcatcaacatgcaggactacggattgatgaacggtgaaaaagcgttaaaggcctcactcaaagccattgatgacagcaaaggagcggaagcctgatgccagaagacgaccaaaatcttgaaaccgttatgggcttgatcatgaacggcggcaatgccaaaagttcagcctttgaagccattcacgctgctaaggccggtgatttcaagctggctgacgataaactaaaagaatcggatcatttcctcaccgaagcgcataacgtccagaccggcatgctcacagctgaagcgcaaggcgaccacgccaaagtcaccctgctcatggttcacagtcaggatcatttaatgaatgccattaccttccgcgacctagccggagaaattgtcgcactgtacaaacggttagccgaaaaagaggcctgacaacacactgtagtcacctgcaaaggcttatttgttgtgtctaattttcgatatatcgataccttccagaaattcaaagcaagcaaaaagacgactcacttgaagtcgtctctttgcttgctttattttactttgactgccgctgtgcttgccattcctcacgtaagatgccgtacttcacggaatcccaataccgatcctgatagtagcgaacctgccgcacgcgggcttcttgtttcattcctacagacttggcaaggccgatcatgcgttcattgccggaccaagttgtgatccccagatgtggcaaatcaatgagtccgaaaatacgatcaatccactgatctaatgcctgcttgccaatacctttactccaataagtttcatcgtaaatcacaatgcctaaatccagccaccgttgcaagtcgccatcttcgtagtgcgcagatacatccccaaccagaatgccatcgacccaaataccattgacaaaaggattcgccacccattggtaccctgtttgattagcctgattctcctgcatctcttccagtgtcggaactttatcgttaaagtaaggtccattccatttgtgccattctgcattgggatcggaaaaggcaactttccacaacgtttcaagatcctcggtttgaaaatgttttagcgttactgtcatgcctcagcactcctcttttatgtttgttaacaacataccacaattattgcccgggaaataatctaagttgtagctaggttaatctaaattttagtatgacacttatttggtgctggtgttagaccatatttaacctgtaggctggttggcgtatgctgtagctaggtttggtgatttgtgtttttgggtgctgcaggtggtgctcgctcaccggcgcagaaacctgcgtgtaaggaccttaagcgcaatggtcaaaacccggttatcacgcttaaggccgctcatgttctgatttatgcccataacgcgctcaccggcgcagaagtctgcacataaggaccttggtcgtaatggtcaaacccgggcagctcgcttaaggccgcttatgttctggtttacgcccataacgcgctcaccggcgcagaagtctgcacataaggaccttggtcgtaatggccaaaacccgggcagctcgcttaaggctgcttatgttctggtttatgcccataacgcgctcactggcgcagaaacctgcacataaggaccttggtcgtaatggccaaaaccgggcagctcgcttatggcggcttatgttctggtttacgcccataacgcgctcaccggcgcagaagtctgcgtgtaaggaccttaagcgcaatggccaaaacccggccatcacgcttaaggccgcttacactccgacttctaaccgcgccggttcgcgcttactttttttaggaggttttcccttggcagattatgttaaacagattcgtgcaaaagttggccatacgccactgattatggctggggttattggtattttggctgatgaagcgggacgggttttgtttcagcaacgtagcgattttaaaggtcaatggggtcttatcagtggcaccattgagtatggtgaaacgcctgcacagaccatgattcgcgagtttaaagaagaaacgaacttaacggttaaggttgtttctttgctcggggttgatggtgacctcatccttacttatcccaatggcgatgttgcacaatggctttgtccggtgtttctcgtgaaacaattaggtggcgagcttagtgccgataacgatgaaactgaagagttgcaatactttgcgccaagcgaggcaccgcggctttttaatcagcagcatcgtgccgcattggcccatttcattgctgacgaaacggggtacttcgattaatgaaacaacttattatcctccgaggtaattcaggtagtggcaaaacaaccaccgcaaaggccttacgtaagcatctggctaactcgctgctaatttctcaagatgttgttcgccgcgacatgttagccgaaaaggataagcctaatagtcctaacatcgaattgattgatctgattgcccgttttgggttttctcatcaacaaattgtgattgttgagggtatcttaagtgcggctcgctatggccaaatgcttaaagcgctcatgaccactgccgatcaaagtctggtttactactttgatctatcgtttgacgaaactctccgacgccacgcccaccgcccgcaagcagccgcttttggcgcagaggctatgcatcggtggtttcgaccgcatgactatctgggcgtccccaatgagcacttgattcaggctgatcaatcacaagacactgtcgtcagtcgaatactggccgatcttaacaagcgaaactctgatcaagcgcgctattccgactgaaaccttagcccacttcggaattttggtttaaagacgttgtataacctcctcagggcaaaatattactgctttcgtctgtttcggactagaatgatggcgtgatgatgttcttggtaagtattggcattcatgagactgcgttaactggtacggcagctagcaagtaaggaccgaacagcatattgggctgagggtttaaatcgcctacctgttggctgtcgttttcgcagttgacgcccactaaggagtgtttttcatgacaagttatccacgtcgcgatcccgtgacagatcagctgttaaccccggaaaattctgctttgattttaattgattaccaaccgacccaagttgagtcgattggctcgatgaatcaccatacgctcattcaaaatgtggtgatgacggccaagttggctcaagtctacaaagtgccgatcatcctttcaactgttaacgtcaaaagcggtcggaataaggacacgattcctgatctgaaaaaagtccttggtgatctgccgagtattgatcgaacatcgattaatgcgtggcaggatcaggactttgttgaagcagtcaaagcaacgggccgcaagaatctggttatggcagctttatggaccgaagcctgtctgacttttccaacccttgatgctttagcagaaggcttccatgtctttcctgttgttgatgcagtcggcggcacatcaacgattgcgcacgaaaccgcattgcgccgcatcgaacaagccggtgctcagttgaccacgaatgcccagttagcttgcgagtggcagcgtgactggaatcgaaccgagactgtcccggattttgttaaattgatgcttgagtcaggcgacttcatcaatctgggcgcttagtttaaggtgctacaaggatttacaggttgaatcggtcttagaggcgaaatatgtctctaaggccgatttctcttttcgcatacgccttgttctagccggatcagtcaaaatatcgttcccacataaataataggtgggtcgcggaggtatttcatatgcaacatcttacaaccacgtctaaacgctggtggttactgattgcgttgggcttttttgcgtttatgacgaatcttgatggttcaatcgttaacattgcaatcccgctgatggccaagaaccttcatgtctccgctagccggatggaatggactgtgtcgttatatctgattgttttaagtgctttgctgctgccttttggtaaactcggtgatcgcattggtaaacgccggattttcaaatggggtacagggacttttgtgcttggttctttgatggcgggaattaatctgggctttaactttttgatgttgggccgcatggtgcaggcgctgggtggggcgatgacgttagcgaacacttatggcatcgtgacttccacctttgctttggcggaacgtggccgggcgatgggcgtcgtgagtacctttgtcgcactgggcggggttgccgggcccagtcttggcggacttattctggcacactttagctggccgatgatttttctgattaatgtgcccattggtttgatcgcgctgggcatctccttgtggtcaatggacaatggtcggccccaacccggcgcttatgacggcgtcggcatggtgttgcaagcaaccgccattgccagcgggttctggggacttaacttagcgcaacaaagcggttttagtgatcccctcgttcttgccacgttagcgttggcatttatcagcttagtggcgtttcttggctttgagcatcatcagtcagctccgctactacccatgagtatctttcgggtccgcatctttacactcggcgttttgactgttttcttcatcttcatggttcagttctttagtaccgtcttgatgcccttttaccttgaagacgcgcgcgggctcacaccgggtgcggttggggcgctgttgtcgctgtacccgttgatgatggtcttctttgctccattaggcggatggctggcggacaaatggcaggttcctgctgtcgcgctgttaggtagtctactcattgcaatcggcagtctgctgggtgccacgctcaaactcaacgccccgttaactgtctacatcatcagcacgcttttgatcggcatcggaagcggcttgtttcaatcccccattggcgacgtggtcatgtcagtagtgccaaaagcgcaacttggcattgccggcagctttaatgccttagcccgcaatctcggcatggtaagcggcaccgcggtagcaaccacggtcttatttggcaccatgagtcacttggcagcgcgccgggtcacgacctatcccgccaaccacccggaatttttcatggtcggcttacagattgcgatgctcgttgcggccggattagcgctccttggtgccattgccatcgcactcaccatcaaaccttggcaggcgcacgagaagaactgacgaaccgtcttcaccccggcatcttttccccttcactgaaaaaagtgatagcataaaatcactgggcacatttttgaggaggaaaaagacgcatggaaaagaaccaatcaacaactttgctcacatggggcatacttttggtgggtgcgaatctgcgcctgccgattaccatgatcccgccgctactacccaccattgaacgcacattggggttaccggcttcgatggctggcatgttgaccaccattccactgttgatgttcgcattagcatcgccactcatcgccaaaatgggaaatcggcgcggtaatgagtggagcttgcttattgcactcattattttattacttggcagcttacttcgcattatccctagtctcatcgccttggtaatcggtacgctgctcatcggctttggcatttcaggcggcaatgtcttgctgccggcgatcatcaaggatcagtttccgcagtcgattggcgccaaaaccagcctctacaccgtgaccatggggctagtcgcatcgctgggaaccggactggcaggactattgaaccaacaatttcatatgaagttcaccatggctgccttctccttagtcggcgtggctggcttagtagtctgggcccttgcctttcgtcggctggcaccggtaaaaaatcaggccgcgactggccggcgaaatgttcgcgtgtcccgttcgctgttagcctggtggattgccttatttttcggcttacaaagttttctctattactcattactgacatggcttcctagtctttggcatgcggctggtttttcgcaactggctgcgggcaacctggcaacaatttttcagttgagcggcatgccggcaaccctgtcgattccgtttatcgcagagcggcgtcatggcatggcctatagcgtttggggaattatgctcggttttgtattaggggctttgggcgtgctcatccccggagccaacttcgggttgaatgtggtcttctccttactaatgggcgtggcttccggggcggcttttgcgatctgtatcgtcttcttccagaagaaaactgccgatgcgtacgaaacagccagtctatccggctttgcgcagagtctcggttatctctttgctgcagttggccctgtgctttatggttttattcaaacaaccaccggctcatggaatctgttattatggatcacagtagggttaaccctattcatgtttggtgccggacttatcattaacgccaaacacagtattttcgcccctagtgatcatcggtagcgcttgcacgattaatgcgtattccttaaactgacattgaaggacaacaagaggaggccacaaaatggcaatcacaacaacaattggaaaaagtcatgtcatcaccggcaaacttggtttaggcaccaataaagttggcggccacaacctttttccgaatctacatgatgaagacggacttgcggttgtgaaaacggcgctggatcatggcattgagatgctcgacacagcttatatgtacggtcttggccaatccgaaacgttaatcggtcaggccatccaaggctatgaccgcgcaaaaattgttttggcaaccaaagccgcgcaagatccccatcaagatttaaaaccgaataacgatcctaagttcttaacgcaggcaattgacgacgccttgttgcgccttaaaaccgattatctcgatatcttctacattcattttccagatgacaaaaccgataaggcggaggcggtcaatgcagtcgccaatgcgcgtaaagccggtaaagttcgcgctatcggggtttccaacttctcacttgatcaaattaaagaagccaaccaagacgatcaagttgatgttgtggaagatcattacagccttgtccaccgcgatgccgaaacgacgctgttcccttatctaaaagagcatcagatcagctttgtcccatacttcccccttgcctcgggcttgttaaccggtaaatatgggcctgacgatgctgacaaattcaagaagcgcttttctgctgatgaattcaaagaaattttagccgcacttcgcgaagttgacggcattgcggatgcacatcaagcaacgattgcgcagattatgctcgcttggtacatgaagaaccccgacattgccgttgtcatccccggtgcccgcctgccagaacaagctgccagcaatgctaaagcgctcgatgtcgatctacgggatgcagaatacgaatcgatcaatgagttgttcaaaaacttcaaaacaaagtaaccggcgcttgctgatttccagcagtgaaaataaaccgctccataaaaaaacagctcacagccttcaaaaaagaagtcctgtgagctgtctttttgtcttatacgcctgggatcgttgctacttcttgcgtgtaaaggcgcgctttacgacttgccagaaagttaacgacttaacaattcgctcggcgggaatgtgcacccgaatggcacgtaaaacccgcttaggatctttcgctgcaaacgtatacgtcccattctttttggttttaatggcaaagcgcgggatccacttacctttgaagatgacggaagcaatgacccagtccacttcattccacggaatctgatagaagtcacgtacgtttttttcattgaaaaattcgaatcctttatcaccgatcatgatcttgccataggccggcattcccataaaggccgtaccttcaatcactaactcggatttggtgttgattgattgaaccattttttgccatccttttaaactgaacttgactgtgcttgctgatgtgccttgcttgttgggtttattggttttggagagactttcgccaaaatgcgctcgtggcgctgcattcatgtaaggatctctggcgaggtttaaacttaccctccaaaacgcgctcaccagcccagaaacctgcacataaggaccttggtcgcaatgaccaaagcccggtcatcacgcccaaggccacttatgctccggtttctaaccgggctggttcacgctctccattataaaacaaaagcccagactttgtgtctgagcttttgaagtcttggttcgacttttggtggttgatcttacatcaaaccgatgacgtggaagacaaccccgacgacgaacagaccaagaatgataataattggagaaactttcttcttcagcaaccacatgcagaacaaggtaagcagtaagcccatcaaacctggaattaagctatccaagttatcctgtaaggtcgtaaccttgtttttagtcagtgacaagccttgagattgtaattctaaagccttttgaactccagcttttccgcttggtaatgaactccagtcaatgtaagcacctttttggtttggaacatttgaaacaaccggggtgaacttgacggatacccagcggttaaccagtgatcctaggataaacataccaaggatcgtggcacccttcgtaacttcaccaagcaagccacctgacaagtcttcagtaatcttactacctgctttatagccaaattcctgcgtgtaccataggaaggccatacgaatcgcattccataaaacaaagtacaaaattggtcctaagagattgccggccatcgccatggatgcggctaacgcaccaataattggcttaaccgtgaaccagaacactggatcgccgacaccagccagcggacccatcatcccgactttgacaccctgaatggctttatcgtcaattggggcaccattagcacgttcttcttccagtgccatcgtaacacccagaatcggtgaagccagatatgggtgcgtgttaaagaattccaagtgccgcttcaaagcagcggaacgatcttccttagtatgatacaaacgcttcagtgctggaattaaggtataagcccagccaccattttgcatacgttcgtagttccaagaaccttgaaggaaggttgaccgccaccaaaccttaattcggtcgccttttgtgatatgaacttcttcagccatgtttgtcaacctccttttcaataattatcaataatgtcgccgacaggatcaccggcaccactattcgaaccgccattacctgagccgccgccttgcttggacaatgccaagtaaatcagtgccagtgaaataccgatagcaccaaggccgatcagggtaatttctttaactgttgccagcacaaacccaatcgcaaagaatggccatacttcacgagtcgccatcatgttaataaccatagcgtacccgacagcaacaaccatgcccccgccaatgccaagaccagtcgttaaccaatcaggcatctgttcaagcaatgcccgcactgggccggcaccaacagcaagaattaaacctgcaggaatcgcaatccgcaagccctgcatgcagatcgcgacccattgccagaaatcaattttcccgaaactgccttcttcagcagcacggtccatgatatgaacgatcgcagttgccaaggtacgtactaaggtggtcagcaacaaaccggcaaccgccagtggaaccgcaatcgcaatcgctgaactaacacctttagtaccctgaccgccaagaactagaataatagctgatgcaactgaggccaatgcagcatctggtgcaacggccgcgccaatgttagcccagcctaaagcgatcatttgtaattggccacccagtaccaaacatggggccagattgccggtcacaagtccgatcaacgtgcacgcaataactggctgatggaagtggaattcatccaaaataccttccataccagcaaggaatgacacgatgaggaccagaatgatttgaataaaattcaaagtcatgagtcttcttcctccgtttcaaaaattacttctgcgcattcagttcgtcttgtgctttcttcaaaattgcattcatgtcatccggatgatcagatggcaccttgcgaacgtcaaacttcacaccatcatcagccagcttatggaaggtatcgatatccttctgatcaaatgctagcactttgttaggttgaactttacccactgaatgtgacattgaaccaatgttgagttccttgattggaacgccgccttcgattgcgcgaagggcgtcttccggtgtttcaaataatagcaatgcgcgctggccgccaaagtgtttgtcatctttggccagcttaatcatctgatcaattggcacaacatgcgccttaacgccagacggagctgcttccttaatcaggttcttccgcagttcgtctttggcaactgaatcagaaacaacgataatccgtgttgggttcgttgtcttggtccaggtcgttgcaacctgaccatgcagcaaacgtgaatcaacccgcgccaaaacgtattggaatgaacccggttgaccagcattagccgtgcttggtgcagcagcctgagcagctggtttcttcactttatccagtgcttccggcttgatcttgattccgtcacgtccggcatcgagcaaatgcgctgcgatgtcttgtgcagaatccatcgaaagtcgcgagccatatgcttcaatcaacatcggcaagttaagcccggtcacaatcgcccatttatccttgtgctcctcgtaaatcgagtttgcctggttaaacggtgatccgccccatagatcgattaaaaacaatacttcgtcatctgggtcgaacttagcgatcgcgtcttcgagatgcttgtgcaagtcatctggtccttcatcgggcatgaaggtcacagcttcgactttttcttgctcaccgaagatcatttgaccggattgcttgatgccagcagcgaattggccgtgactagcaagaatgattccgaccatttttacgcctcctaaaaatttgtggttgcctcgaaaataatatctgctaaaaacaaaaataatttaaaaaacaaggcttcccaatagcttagtatgacgtcccgggcacagctatgcaagcattttcactcaaaaacaaacctaaaaaagaagcgtatacattgcaagtacgcttcaaaaaagattttttttaaatcggtctaattggtagataccaattattgcaaaggtttcctaggccttagagggatcgctttcaaaatcggtaaatatcggatcggcaatgcggttacccatcaccaaaagtgctaaacacagtataagtgacaaacatgccatgaccatccagctaactgcggcgctcacgacattggcaattgtgaagaataccatttgtcccactggcatcccgagtagcgcgacgagattaatgaccccggctgtcgtccccatctgccgctcaggaacgagtcgcatcatcactgttgaaagccgtggattgattttgcccataagataggcggttgcaaaactaaagatcatcgctgcccaaagtgactgcagaagaaagaagctgcaacttaaaccgatcatggccgccatcaacaagcccaacagcttaaaggtgctcagccgctgcaggccgtcttttgcaaatagcgcccccagaatcagtcccactgaaaagataatgttcatgatcgcaacagttgtcccgaaattgcgcagccacatcatcggctgttgaaccagcgtgactgacatcaagccgtcaacggatgagcccagtgtgttaaccagcatcgcaaagataatcactgccaacaagaagtgattcgttgtcagaaatcggatcacattgcggatgtttttaaaaatcggttgatgaacgtgggttgcaacaggcggttcggcttgcttgagtcgtttattttgccggatcaagacaaccgccgccaatagaaaggtcacggcattgatggccccaaacagtgcatagttgtgatccagcagaacaatcagactggcgcccactgcctgaaagaccatttgcacggtcgtccccgttgcactctgaaaactaatcgccgtatttagttccttggccggaatcaagcggtgcaagattggcaaggttagaccgttaccatattgccccaacgtatcggacaagatgttgatggtaagcaaccccaagaataacggtaggcttgcaggcaacacgatcatcccggccagaccacagaaaagcaacatctgcccgatccgcgcagctaccatatggcgggttttggcttgcgtccgatccgcgagactgccggtgatcattgacagcatcgtcggtaaacttgtcgccatggcggctaaggtaaccgccagacttttaaatggcattgtagcagcgtagataatgaaaacgatattgtataggctatcaccaatgccacttaacagactggcgtttaaaatggcccgatagccatgattgttcatgtattcatgcatgacgaccacactcctttttgtactgcgtgatgaacttgtttgtactttgagtgtaggtagtctagaataacaccgaggtgaaattccactatggtagaaaaaatcgatccaaccgatggcgccgtttttcgccaattgcggcttaatcaccaccaaaccttggcacaagtagcagacgagcagaattccactgcgtttattagtaaatttgaacaaggcaaatccaatatcagcttttcccggctcagccacctgcttttccgtatcaatatgtcagtggaggagtttcttttcattcgcgatcttcaagccggaattgtcccgccgctcaaggattcggagttcacttacaacatgttgattcatcgcgattttgaagcggtacttgcttttcaggatcgctttagctctgaagaaccaacattggccgactatcgctatttacttaagcaagagaaaatctggcagcaacgttacgctcaggatcacaatcgccaaacccagttcgaatttatcaccattcgaatttttcgcttgaccatgattgatcgggttaagccgcctgaacagccatcgccatttacaaatgttgaagatgcgatgacccagttgcaggcgcttgccaaaccagttgttagctacctgtacacggtcgaagtctggaattattttgaactgtattggtttcgacatctgatggtcgctttgccagttgagacgatccataatcttttaccgctggcgatcaagcgctccgaaaaatatcgtgcgttcaatcaaatcggaaccttgcgtgtcaaaaccctcttttccgcctttacggtcttcatcaatgcccgccagctgccggatgccaaaaaagcacttaccactgcagaacggcttttgtatgacgccaatgatctagccaattcggcactgcttttattccttcgcggctggtatcaagccgtcgccggccaaacagctgccggctttgagttgtgccagcaagccattagtttggaacacattttggatcaaccgcggcaggaacgatggttgcgttatttattaaaatttattcatcaaaacattgcggatcctgaaagtagcgctctttttctgtgagcagtggttaacagccaaaaagcccagcttccttggcgacgtttcacgtggaacacaatatcacaccaaaaaggacgcactcgccatcctctcggcagtacgtccttttcaactgtaaacactcactttaatactgacacgtcacgcttgatctaaacactgtttcataacgcagctttaagcatccttgccacagcgttttgcttctgccagtgcttccagcgccggcagccaggatgacgtccattccggcgttgcaatcttctgcagcatggcaattaacgcgtcaagttcctgttggccgcgcagcgaaactcggcgatcaggggcatcaatcatcaataagcgtttggtgcacgcaatctgaaattcaacccctaaatcaccaaccgttgcctgtctaatgaaggccagtgtctgttgtgcttcttttcgccgtcccgcgtcaatataacgcagcgttgcggtcaaaaaagtccggttagccagattcaagtgatcttgcggggtattcgggctttgcacctgaaccgaaaatgcatgcgtcaactgcgctaaatcacttaaaggaaccaccgcagctagctgcagagcaatcaagcgtagtaacaatgaccaggccgccgtttttaacaataacgtctgtgcctgcatttgttcacgagccagaatcgaaaatcgctccggtgccaggttgtgcagagtcaggtgcaaaagtagccgctgattcgtgttcgctaatggcaattgccgcaagattccggccagcgtctgcacatccccgtggcgaacggctactaaataacggtgcaaaaacggtcgcttattatcggactgtggctgggtaaaggtatcccaatccaagttcaaccgatccagcaacaggaaaaatcgatcggcagctaactgagacgttccattttcaaattttgacagactcgataccgataaaatatcgcccgcagcctcttttagcgtaagtttgcgttctttgcgcatcaacttaaactgtttgccaattgtcaacttgaacgcacctcctcttcaagaaaccgctgccaacttttggtcaacaattgcgcgaaaaaaggagaatctaataacgccaatgtcgccaacaacttttcgatctcggctttggctgcccgatgctgacctcgatgatacatcagcagttgatgctggtaacgcagcatcaaccgcgaataaagatcgtccggcggtattgccaagttcatcgcaatatgccatagacgggtcgcatccgcaaactcacggcgatgaatcaacaaggcaatgctatttgtcaaaatagcccacaaatactgatcccgcaccggatgacttttagtatcaggcaagtccagaaccattccggtcaccaaattaaccaactgctcactgtcataaagcatcaaggtagccgcaaaaagatccagttcatacaagccccaatgccgaatccgttttagatacttgatcacatcatgcttcatcttcatagtggtctgaaagctcggatcggaaaattcattatgggctaaaatattaatctgattcaggcgataaaagacaaatcccgtttgccgccaaagctggtactgcttctgcgccaacgcctgcaacgccgacttacctgctaccgttgcccgttccacttcttgaaaaaagttctcctgattgagcgcccgatacccttgctgaatcgaggccacgtcttggtcaaatcgagtcaacagtttcaaaaccacagcggcactaagctgtgtctcgccgcgttcaaaccgtgacaaagtagcggccgttgtgatcccagccgctatttcttctaatgaatcattttcctcgagacgcaaagtacgtaaataggccccgattttgatagcttcctccgtcatcagcacccgacccttttatgagaactttattaaacaaatttaacacgttttgccattttttaaaatatctttttgcttgtatcttcctgatgatatgttttaatcaagtatgacaccgtttacatcaataaaacgaaggagaatagccatgagagaatcgcaaacctggatttcttttttaagcaccagaaaccccgccctcaagatgcgtcccttggcatactgtttcataaagacttgtctattagccggcccgtatagcgcttttatgagcttgttcatcaccggtgaaatattatggactttttccgcaattatctttatgtgcatcgtggtctttgttgctaatatagttgcagctatctcctatgcaaagaaaggaaccttggtaagcctttttaagtccaaaaagaggtggctcgtacaagcttttgcttcagcgttgggaacttttttactactttcgctcaggctcttagtcgcatatatgtaaaagcgattgctgcccagacttaaactctgactatgactcttcaaatgttggttaagcttcgcagcgatgcgtcatggctttagcagaagctatagcattgtcataaagcaccttaactctgccaacttgaacttttaattatcggttaacaatgtctcagccttgccagctgtcaccttcatgtatagagaaaagttaaaatacttcgcctctaacattctaactagcgctatacgtgctatgattagcaccaccgttattcactttatcaacaacttgtgctcatttacattaagaaatcgcgtagaggggtgtgataattttgggccttgtagaaaactggtttccgtttatctggttgctactcttaggaagtgggagtctttccgtttatacgttttatttgcgtcgtaagtttcactacaatccgtacagtctgaaaaaggcctttagtaattcaccaactaatccctttcaatttggaaaacaaagcaattctaagatacgccagttaataacttggtcaaaggtgacgctgcttctttttgtaattaccgatattgctacattcgttcttttaattatgaccatcacagatgtcatttccaataattcaattgataatccttggtcaatcatcattgtgagttcctttgctgttggactagggattctttttaacgtcatcgctcagaaaaaaatgacattacagataaagcactatcaacaaataaaaaataaggtaaccttcgcgatgccgattcaaagtttttttgacagtcaagcgccgtctgtcggttttcgtatccttagcctaagcattatcaacctagtttgtctatagagcgctatttttgcgactgttatgcttctagcaatccctaaccttcattaactctgcatttacacttactttttctggcttagtacttgtattgagtgacgatgtgttatgatcgacaacaacaccactgcatgctagtgttgcttccgcacccctgtcttctcgaggaccaacttgaaagcgagtgatatgctcttgtccttttcagtaaattggttaataatggcgattttccccctatttctcagtatctgtctttcagtttattctggatacttaaggaaaaagtttaggattaatcctattagtataaaaaaggctttcaaaagttccgatgatggttattttcgattcagagaacaaaataattctaaaataggcaaattggcgtatttgcaaagaatgatgctggttattattggactcggttacttcattagtttggccttcttgctttcaattttttgggaactctttaacaggcatcctttaataagaaccgctcccttcgccttatgtgctgtgtctttaacgttggtatttgatattcttcttcaatcgactagcaaaaagaagttgatactccaaattatggaataccaacatcttaaagcgaaagggtcactaactgctccggttaaggattttttcggatcaaaacagcctttgattagcatgagactgtttactctgggaatgaccagttcggccctcttgatagtttcctttttctgcctctttattgatctaacgcagcctctatcccgttaaaactatccaccaaaatgttgggtaattttttcacggtgaattgagttcactgctacgaactgtcaaacttcctttgagtatggcaatctattcttgttatttagacatttctagaggatttcttcacagtattagtttagatcaatattattcctgacactgtccgcctggtgtattctcttgattttggttcggcctttaagcttccctgacgttcttaattttaaatcattgtcttcattaaagttacagatgctgacaattgacatactccaaaagactctttgaatggtaaaagcagactttgttaccatcagaaaattgcttcccgttattttttgatatcgctcgaaaggtagtgacgtttctatgttttcactatatagttgggttatttatgccatactgtttctcatcgcaagcttttgctgtgccttttattcactctttatccggcacaagtttaagctccatgacagactattgacgaaagtatttggtgatcccctccataatccgtatagattcctagaaaccgaagatgatcaaattgcccgcttatcacaagcgtttaaattcaccacgtttatagggattggttgctattttattggcttatttctctttttcaaaaacctgaatgatttctcaaaccaaattaatctaggcttaattgccattaccatttgtttcatgttaatcggaatcatcagtttgatcctagcccaactaactgatcagcaaaaaatgatacgccaaattaaggcgtatcatcaacagaaatacaaactaaaattttgtgacttctttgattctgctaaaccaagtgcaagcatccgccgaaatcaggccaacatagtcggattattatttctactagcaatgcttttttgcattttcatgtttttcaattcagtaaattcttctcctctttcaacttcccgtatcacaccaacctatcttttgttaggcaaacactaaaataagcgccccgccaacaatcaccgctgtcgcgaccaaacttgttgccgccgaaagatagtttgttcccatatttccagctaaatctaaggaaaaacctgttgaaaacactggacgctcggcgaccttaacctcaggatgattctgccaatagataggcagaaatttaatcttccagttaaccgcaatattcacatcaacatttgaaagctttttagctttgataacgtttacggtgatatttaactcgattgtcccaatttggtctgttttaattgagtaatcgattgacccttgcgaaatctttgcccccacttgcattaccttcgactgatcaattacagcttgataactggttgcatctttgatgtttccaaaattcgactcaaattttttctgcaatgctacactatctagtttgccatctttaataccaatagggccgttcccagccgtgaaatctactgaccaagtggcgattacgcctgggatcggcattggaaacgtgtattctttgcttgctgagaaatttaccaaatcgtcaatcaagccattcatcaagtcattagcaacaactacttttgctgattctggtaaagtaccaggtgtgaatgtcttcgtgcctgggtcactaattttgacgtccgttgcaacctgatcaattggaatgtcaccaatgctgtactcaataaattgatcgaagctccagttcaacggcattgcataacctaaattacctgaataacccgttgacatatcggatacgaaacagcgcaccgcgtatcccgcttttaagacatgtgcacaaacatttcgcgtgccatagattccagcacgaaagcctgatttagcaagccctgaattgacaccccgcatataagcgaccacagttgcctcaatatcgccttccagaatgtcaacatcacaagcaaagtagataatagtgctattaggaaagccaagaactcgtgcagttgaagcagccgtcattgcatcaagcacaccttgagtttcggtgaaatatttaatgtcggcgccgccatcttgatagattggaaaaatgctcatgccgccatcggtaattgatttaatctcagacgcagtcaaattcttaggagtaaaagcattccctactgaccccgttagatatcgcccgacaatgctgaaaccatatttacgtaacaatgcaacatcagaactcgtcagttgcttagatgtgtcacaagcgattgaatcgcgtgttgtatcaccattgctagttaatagccccttaataacccgattaccagcgattctccctgtggttggttccaggttcatcattgtgctaaaggcagccactgcatcgccaactgcactggtgaattggccattagtcggaatgtctgtgaaaccatttactaacagaccgtattgtaggatgcgaacggcgtcagtatctgttgatccctcagataaaacagggcaattgtcaattgtcttctgcccatagataccatttgcaacatcagcagccatcccttcagctctttgcaatgcataaatcaaagctgtgttagtgtcacgttgatagatgccatcgcaaggtagaatgccaatgatattactgaaccgtccattaagatattgctgcattgaccgaaccttctccgatcccccagtaaccaaggtaaatgcagccatatcgaacaacgccgccaaaagattaactgtaactacaccatttgcggtaatacccgcgtagtgttttgaaagcttgctctgttgcatcagaaaagtcctgattaaagtcgctaccaggattgatgcctttacaccagaaggcgccttgaatgagctgggcgatattgcccttataaccgggcttcaaactgcctaccaccgaagctaatgctgtcttggttgcatcgccaaatccttcaccaatagcgctaataccaatttcatgttgtaaacccatccgcaaactataaatagtgggccatccagtttgtccgttctcgggcgctgtcgtgaagccagaaacaccgctatatgtcttattaagccatttttgaacggccagtaccgcttcatctgccattttaaaaatctcttttacaaattttaaggtgacacgtctgtcatcgaattaaaccgaacacatgttcgatttaattctactgcggagacttctttttgtccaaacttttcttaaataaacttctgatcgcacaaaaaccaagttagcgattacgattactccacaaaaattgacattccgcccccgttccgctacactcgtttttgacatttaaatacaccaccaagaaatagaggttgcggtgggcaacgaaaactggggagtgccgagtcatgttgaaccagtcgtaagtgccgccgccgaaatgttggatcgtattcggacgattcgcattgggccatgggcgcataacccatggactgtcgaagctggttgcttcggggcgctatgattctggttcatgactaaaatcgatggaatcgacctttattgcggtatcaataaaggtcgattttttggttccagctctatttcccactacaagaagggagaaatgtcacttatgagaaaacattgggttgcgcgtttaggcgtgctagggttcgcattgagcctcctgcttggcagttttgccgcaacacctgtcagtgctgccagcgatgacaacacgtttaaagtcggaatggaggccggctatgcaccgttcaactggacgcaaacaacgagtgccaacaatgcggttaagattcaaggcagccaagaatacgcaaacgggtacgatgttcaaattgcccgcaaagttgccaaggcgttgcacaagaaggttgtggtggtcaaaacatcatgggatggtctgccgcctgcattaacttctggcaaaatcgatgccattattgccggcatgtcgccaacgccagatcgtcgcaaaaccatcgatttcagtaatccgtactatatttccaacctgacgatggtcgttcgcaaagatagtaaatatgccaaagccaaaagtattgccgatttcaaaggcgccaagattactgcccaactgagcacctatcactatcaggcgattaatcaaatcaaaggcgttgtcaaagaaccggcgatgaacgattttccagccatgcgtgtggccttggaatccggcacgattgatggctatgtttccgaagtgccagaagggattacggccgaacgtgctaatccgaatctgatgtatatccactttgccaagggtcagggatttaaaaccgatgccagtgatactaacttagcgatcggcctgcggaaaaatgatcctaataaggccaagattaatgagttgcttgctacgatctctacaaaagaacgggcacggttgatgaacgaagccgttgataatcagccgtcaaccgaaaaaagcggtaactggttcatggcgattatgaaacagtatggtcccatgctattgcgcggcaccggcatgacgctgctgatttctttggtcgggacacttgttggctttatcatcggtttgctggtcggtattattcgaaccacgccaaagccaaagaaattgggtcagcgtgggttacgggccgtgatcaactggctgctgtccgtttatattgaagtcttccgtggtacgccaatgatcgttcaggcagcggttttgtactatggtgcggctcaagcctggcatctgaacatggatcggacaaccgcggcgttattgattgtttcgattaacacgggtgcgtatatttccgaaattatccgtggcggtattatttccgttgatgaaggtcagtttgaagcagccaatgcgcttggcatgacgcatctgcaaaccatgatgaaagtcattctaccgcaagcggtacgcaactctctgcccgcggtcaccaacgaatttatcgttaacattaaggatacttcagtgttatccgtcatctcggtttccgaactgttcttcagcggcgaaacgattgccggacaaagcttccagttcttccacacgtatctgattgtgagtggcatctacctcatcatgaccttcaccatcagccgattattccgtctcatcgaaaagcatctcgatggtccaaaagattacaatgtgatgaacaatcaaatgcaggtcgaaacacccaagatcagcacggcaaaggaggactaactgatggcaaacgaacctttaatccaagtcaagaaccttaaaaaggcttttggtaaccatgaagttctaaccgatatcaatctcgatgttcaagcaggcgaagtcgtttccattattggtcgtagcgggtcaggtaaatcaacgctgctgcggaacattaatcttttggaaactcctactggcggcgacattctttttcatggcaagagcattctaggcgatgatgtcaagctgagtacctatcgtgccaaggttgggatggtgtttcagagtttcaacctgttcaacaacatgaccgtcttgcaaaatgtcatggtgccgcaacaaaccgttttgaagcgtgatgctgctgccgccaagacacatgccttggaattgttgaaacaagtcggcatggacccgtttgttgctgctaaaccggatcagctttccggcgggcaggaacaacgggtggcgattgcgcgagccgaggcgatggatcctgaagtcctcttgtttgatgagccaaccagtgcgcttgatccggaaatggtcgatgatgtgttaaacaccatgacggccttggcgcataccggactgacgatgatcatcgtgacccacgaaatggccttcgcgcgcgaagtttccgatcgtgtcgtcttcatgaataatggcgtcattgccgaatccggcacaccggatcaaatcttcggcaatccgcaacaacaagccaccaaggaattcctgaagcgttatttgaatcgggtatgatgattcaagtgcgtgcggttcttagttgaaaaaagcatacaaaaacgcgaccctgaatttccgagggtcgcgtttttggtgccggttagtattcaagtataaccgtgacagattcaccgtttgaccggcttatttgcttttgaagctgcctgctcacgcttcttttcccgatgttctcgccatgtgtctaaactgacaacgattaaaaataggaaaaagccgcccacgactgactctgccgtcaaaacaagataacgcagcgccaggtacccttttccagccgtaacgtcttgatagccgacatagccaaacgtcatcagtacggctaggcccaagaccagcagcgtataaatcagggtgcgttttaatatccgtttgaatgtcgtcatggacatggcctactttctatcggttcgttaacgattgtctttcaaaatggtttctgcctgcttttgtaactgagtcaaaaccgtcttcggtgccgccttcttggaaacggtctggtcaacggcatccagaaggttattacgataggtgttatagccaatgaatggggttgatgaaaaggcgtcgtcataagccttgatcgcagcctgatatggtgggttggccttcagatatgcctgataagcacttgatttggttgcggtcgaaacaactggcacgtatccgctcgccttggcccattgcgtctgaatcttcttactcatcaagaatttcataaacttaacggcacctttgacttgtgctgccgatgcccctttgaatacggaaatgccgttgttgcctagaaccgaactggctttgccttcaaaactcggcataaccgcggtgccccagtgcatgtctttaggtgcggtacttgcaatctgctgaatcgtggcactggaaccgaagccggcgaagatcttgccttggacaaatggcacattaaagtagttatccaacccagcggtgacggccgtcttgtcttgcaacatgctggtaatcgccgtcatcgctttaatgctggccggcgtatcaatcttggcctgatacttaggggtaatcaggcggttgccggcatcataagccagcgtttcaaactcaaagtcatagctcttattaaaggcaacgccggtgataccgtcacctttgagctgctgcccgatcttttcgagttctgaccaagtcttaggtacactgagatgatacttgtctaaaatgtctttattgtaaaacatgatccgagtgccagtagcaaacggaatctgataatagctgccatggtatttcagattggtggcgatcccgggataaattgatttcaattccgcagaagaaaactgatccttcacctgctgatcaatattgaccaacatcccgtcatgaacgtattccggaataatcgtgtccgtcacttgcccaatcgtcggtaacgttctggatttggccgatgctaagtatttcttttgcagattatcataagagccttgcgaagttgcaacaactttatactgcttctggctactgttgaaaatcttgatataactttctagtgccttgttgtaattaccggtcatgcgatgccaaaacgtaatggtaaccggacccttggagcttttgggtgctgaactgccgccgctgctgcaagcggtcagcgccaatgccatcaatccggtcgcaataccaagtaaccaacgtctcttcatcatgattccctccatcattgcgttgtgtcatggacaggcccgctaacttaccggccccgtccggctaccaatcatctagaaaccacatacagtataccaatactcacggcagctaggggattttgttttatcataacgcgttcgccagcgcagaagtctacgtgtaaggaccttggtcgcaatggtcaaatcccgatcatcacgtctgaggacgcttatattctggtttacgcccataacgcgctccccggcgcaaaagtctgcgtgtaaggaccttaagcgcaatggccaaagcccggccatcacgcttaaggccgcttacactccgacttctaatcgcgccggctcacgctcactttctataacgcgctccccgacgcagggacctgcatgtaaggaccttggtcgcaatggccaagaccgggccatcacgaccaaggccacttacactccagtccctaaccgcgccggctcgcgctcacaaaaaagaaagccgagaatcaatcccgctttcttttaccaagttatgctgtgttatgctgcttgtttgtccttcaacttgagatagaaattcgcaaaggtcatagttcgatacggcatgacccaaatagccgccaagccaaatgtgatcagttcgagcagccaccaaccgagaaaactcaggatcaagacgaaaaattcccatttgtagccttccatcagctgccggctttgggtaatcgcttcggtatagccaatcggttgcccacgatcaatggcgtcacgataaagccactgtgcctgcgaatatgccaaggctttgacgattcccggaacaatgagtagcaatgtccacagaaagacccacacccactgcaataaaccaataagcaggctgcctagaaaatactcgcctcgttcaaatattttgaacatctgccgccaaccaaaatgatgatccgagcggccgcgcagcccatccatcatggcaaagccgacgccaatcatcaagagtaatcctgaaagcgagacaaagatgagaattgattgccacatattcaagtattcattcatatgactacctgtgactgtatcgaggcgactttttaccagtatttgccattcaccgtgatgtgcttcttgaatcgttggaaacgggacaattgccgccaaccctgtcaaaagcaacgccggtaaactaataagtaaataatagctgaaattgggattcaactccgccttagcttgatcttttaatgctgtccgatccatcgataatgcccccttctaacgacgatcacatgttgtcatcgctggggctatcataacagaaagcgaccattctagacgaattttagcggcacctttggattaagttgcggttttccgcgcaacaaagtaaattcatccccattaacggtcaactcggtcttggtatcaaaaagtccacaggtgtaactcttaatcaacaccggtccgactggggaatcaaggtgcgcatcaaatacatctggcacattacggcgcggcaatatcagcagactgaatttagcttgcgttggatcgtgatacgaccgcgaataagggccgatgccatcatttaaatctaaaatcaagacccgatccgcgcgtaatagcggcgccaaccgagctgctgcctgtgcagatatattaagctccatattccgctccttttagtatcataatccctgttttccccattatgaatccattgtcgccaggatacaactggcttgtaaaagtttatcgaaatgcctaaaattggagtaacgagttccaatgttatttagctagctaagacgaggtgtgccaatgaatatttattcggctttaaaatttgtccagatcgatcatgcaccagtcaatcatttacaggttgtcgtcaccgatcaaagtggcaaacctgatgctggcatgacagacttattaatcgactgcctcaacaagatcgacattttcgttgatctcagcaccaccgaccgcgtcagtgacgtgattgatgatctcaatttactgacgccactgccttatgatgttctcgaagaatatcaaaagattctcgagcagcccatcaccggtatcaacatcgccatgaaaaaacagttaatcgaattcgtttatgcgcccttagtttaactgtccatcacggtgcttcattcttacaagtccgcctgtcggtaagcaacgcatgctaccaatgacagggggatttttttatatggtgagcgtgaaccggcgcgctcagggatcggcgtgtaagtggcctggggcgtgatggcccggttttggccattgcgaccaaggtccttacacgcagattcctgcgccggtgaacgcgtcgtggctattatctcacaagagtgcacccagtttcgactggcattcgttaaaaaacccccgttattccaacacttttgaagcgtaaacggtttcgtttagaccaattttctgctatcctgacgaaaacggaggcgacgaacaacatggaacaaacaggacaggctttaccggccaccattcaacgaatctggcgtgccagtgccgcaatctgggctttggtcattctaattgccggcttacttttgattgcggcgtggcatttttggcattggtcgctatggttagcaataggcgccatgggatttgccattttacaattgattttccgtcttgctttagtgccctatcgctaccgtttctggcggtacaacattacccccacagccgttttcctacaaaaaggcttcttctttcaaaaaaatgaagccattccgattgcccgcattcaaaatgtgacattagaagccgggccgctgctgcaatggcaggaacttcagcaagtcaatatcgaaacggccagcacggcacatgttattgacggtgttacccgatcggttgcggatcaactgcgaaatcagattctacaactggcccaggaggcgcgcaatgaatgacaaacccaaaagccttgcacccattgccatccccattcattggttgatgtcatttattgcttggtggccgctatttgtcagtggcggcttttcaatcttgaaaaatgatatgaagccccaagaatttttgttctggatcagtctggtattaggcattttggtattaacgctgctttggtccatcgtgcattatttgcgctttacctacttagtcgcaccagacggcttgaccatcaatagcggagtcttcattcgaaaaatcaatcacatcccatacggccgtattcagaccgttcaacgccggcagtggttctttttaaaaccgcttggcctggagcaggtctctattgaaactgccgggaaggaatccaagaaggctgaagggatgctcgccgccgttccgaccacggtagcggatgccatcaatcgttatcggcaagggctgactgatacgccaaccgcttcggctagtgaccctacgactgagggtgcgcaaaccgaagtaacaccggcggcaaaaaccccagacgctgcttacaaaatcaatgcgcatgatctcaatcaatatgcactcacttcgcttgggttcattcccatcattaccgggattctctggctggtccaaaaggttcaggaataccttcccgacagctggtataagcaagctgaacacgcgctaaccggactggccatttatctgattattgccttaacggttatcgtcttagtgctcggctttgccatttcctacctgaacattttgcagcgctattaccatttcacgcttgatcgaaccggtaacgaattgcaaaccagtcgcggcttttttcagaccaacaccgtcagtgcccaactatcccgcgtccaagccgtacgcttcaagcaaagcgtgttacggcagtggtttcatctcagcacggttcaagcacttctggcatcaagtgctgccgatgatgaaaaaaacgatgatttggttctgatgcccgtcatcaggcaacgacaagcgctaacgaccatgcaaacattcatcagctggttgccaaccgccgcccttaaattagagccgataccgactcgtcatcgctggtactatgtgcgaaacatcgtgctaggtaattttggcttgatcgtcttgccggctatcttagccagtaccttatggctgcatctcagctggtggctgtggctcttaccggttggcttgctatggctcgtcatcgttgctttacaaggccaatatgccggggctaatgcagcaatcggcatcgcagcccccgatcagctcgtcattcaagtgggcgaaacctggacccggcaacgttattttgtgcgcaggaaagatattcaagccatgagtttcaaacagtcgctgtggatgaaaccgcgaaaaatggcgcatctggaaattcacatacgcaaaggcaataacgatcagagtgtcagttcacggtacatgaaagccgatttagctaaacgcatcatgagctggtaccaaccattgccttaatcagtcgctttaaaagtcaggggtcttaccgttgctactcaccaagatcgaatacgcaccaccacgtcatcacagcgattacccgtttaatttaccttggcaagccgattttcacgaattaaccctgaccagtccggtgactattttaaccggcgataatggtagtggaaaatccacgttgctcaatgcgatcgctgccaactacaatgccatcctcatgagtggtgccgctttggaagacgaccctgagtatgacaatagccgcgccttggcccgccaccttaagctaacgtggacatatcggaccaaagccggctttttctttcgcgccgatgatttcatttcattcattcgcgccacccgcggccgcatcaagtacgcgcaaacacaacttgaacatctcgccccgcaaagtttggagcgtctgccctatctcaataccctaagcgcaatcaaacatttgtatcaggtggatttagacactttatcccacggccaggcgtttctggccttatttcgggcgcgattgcacgccaacgctttatatttattagacgagccagaatctcccttgacgccggaaaatcagctcagcctgttagccctgattcataccgcagtcgcaaatggtgcacagtttatcatcagtacccattcccccatcctgatggcttatcctgacgcccaactgctcgcattaggcaacaccttggcacccgtgcactatgatcaaatcgaccatatcacttttctgcgtaacttcttagatgacccgcaacgtttcgtctatcacctgctcaacgactaagcgattggcatgatcgctaaaagtgttttaagctgagggtgacaagtagctaacattgtttgtcaaagggaaatccgatgccaaaacgcatccatgaaaggagaaggcgtatgctaacagcagcttggactaagcaattaccgttacaacacattaccgcgatcacaccagtaggcggaggcgatgtcaatcaagcgtatcgggttgacaccgcggaaaagccttattttctactcgttcaaccaggctatccggccaatttctatgccggcgaaattgccgggttaaagtcatttgagcaggcagacattctggctccacgggtgattgctaatggcaccattgagggtgatggctacctgctgcttagcttcctgaccagcggcagtggctcgcagcgtgatctcggtcacttggttgcccacttacatcaacaccacgaaccctctggccgctttggcttcgactatccatatgccggcaccagcgtttcgtttgccaatgactggaccgactcctgggctgacttattcatccatcaacgcctcgacaagctcgccgcccatctgcgtcaaaaaggcttgtggcaagcaaccgatcagacaacttttcaacaggtgcgaaccatcattcaaaaaacgcttaatcagcatcatagtgaggcgtccttattgcacggcgacttatggggtggcaactatatgttcacagcagacggtcagccggcgttaattgatccagccgctttgtatggcgaccgcgaactcgatatcggcgtgacgaccgttttcggcggcttcacccaagacttctacacgggctatcaggaagtttatccacttgatcccggctatcagttcaggctcgaattctaccggctgtattatctgatggttcaccttgataagttcggcatgggctatgctggcagtgtcgccgccgtcatggatcgtatcttagaccacggtttggcgtgagacgtccatgttctgctaagcatccggattatttcccgggaaatgtgacagcaatttcgaaaataccactcaaaaaatcggctcaggataatatcccgaaccgattttttagcatatcttatgattaaatttgaataacctcaggcattcaaaaccttatttaagaagctcttagtacgctcctctttgggatgctcgaaaatgtctgtcggcgtcccttgctcaaggatcgtaccgttgtcaaagaagaccacccgatcagcaacttctttagcaaagcccatttcgtgggtaacgatcaccatcgtcatcccttgtttagcgagtcggcgcataacgcccaagacatcgccaaccatttccggatccaaggcactggtcggctcatcgaatagcataatatccggatgcatagccaatgcccgggcaattgccacccgctgttgttggccaccggaaagctgtgccggcatcgcatctgccttatcggtcaagccaaccacttcaagcatctccttagcttgttgggttgcttcttctttgctggcaatgcctagttcaatcggagccaacgtaatattacccatgaccgacatgttcggaaacagattaaaatgctggaagaccatgccgattttttcgcgaactttattgatattcgttcctttatgcgcaatgtcttcaccgtcaatcaagatctcgccgcttgtcaccgtttcaagaccattgatcatccgcaaaacggtacttttcccggcaccagacgccccgatcatgacaacaacttcattgtttgcaacgtttaaattaacgcctttgaccacatcgttatcgccaaagctcttgtggacatttttcatttcaactcgatactgactcatgctttcaccttcttctgaacccagttactcagccaggttaatagggtaatgataattaagtaaatcaatgcgaccattgtccaaatcttgaacccttccatgttccgggcaatgatgattttcccggtttgcgtcagttcaagtaagccgatgatagacagaatggacgtatccttcaaggtaataataaactggttgatgaaactcgggatcatgatcttaatcccttgtggcagaatgactttgcgcatcgctttaccaaaaggcaaccctaaactgcgcgccgcttccatctgtccgggatcgacggcttggatgccgcctttaacaaacgccgccgtgtacgccccttcgtttaaggttagggtgacaatcccggcgatgaatgccggtacttttgatccgatgagacttggcaccccagtataaatgaagagtgccagaaccatcaacggcagtccccggaaaatataaataaatgttgttgcgatgccttggcacaacttatttggaatgacgcctaagaagccaatcaaaatgccgaccaaagtagcaaagaaaatggcgacaatggtcaagaccatggtctcacgcaggccacccatcaaggtcgaccagttggctttcagtaagccgataaatgaccgatcagtggtctgactgttgccagcggcggtcttttgcgattcggcactgccattgccaaggtagtgctcgatgatcttatcgtattgcccattggcccgcagcttcttgaggccggtattaaacttgctgatcaatgcctgattattcttagaagctgcaaacccataagaaccttcacgtgccggtttaccaacaagcttcagtgccatgccgttattgatcccgtattgcatgactggctgatcttcaaaacacgccgccgaattacccgtaatgacatcctgatacatgttgttcgagtcatcaaaagtgacggtcgtaaagccgtatttttgtttaatgctattggcataatcggccgaatccgttccggtcttgatggcaacacgtttgccgcgtaaatcttttaacgacttgatcgtactcttcttggcaacggccatgaccacgccggatttatagtacggatcactcatcaaaaacttttgcttacgttctggtgtgatggacataccggcaatcacaccgtcaatctgttttgcttcaagcgcctgcaccgctgcattgaagcccagcggtttgatttcgaccttgaatccttcctctttggcaatggccttaatcaaatcaaggtcaatcccgacatacttgttatcctgattggcaaattcaaacggtgcaaaagtgacatccgttccaatcgtatatgttttctgtgctgccgccaccgtcttgccggggattaatgccccgagcattaaaggtaaggcgattagcagacttagcagccatttccgcttcaacccaaacaccacgctttctaatgattaccagcccattaggccgttattgcatgcgccagtttaaaaataactggttgtgcgccaaccaccgtcactcagtacattgctgcccgagtctggttctgccacctacttgtttaagtatgcggccaagcgcagctcatctcctcgtactagttcgatttttaaacttactatcctatgctagcggaactaaatagttgctgtccagcgttgatgttagcttttcttacatttgtcacattattttacgtagccggtctaggcctccatacgttgttgtacccagttgctaagccatgtcagcacggtgatgataatcagataaatcagcgcaaccatggtccaaatcttgaacccttccatgttgcgggcaatgataatcttcccggtttgcgtcaattccagaataccaataatagacagaatcgaagtatccttgagcgtaataatgaattgattgatgaaactcggaatcataatcttgatcccttgtggcaggatgaccttccgcatcgcttttccaaatggtaagcctaagctgcgggctgcttccatttggccgacatccactgcctgaataccacctttgacaaaagctgccgtgtacgccccttcattcagcgtcagcgtgatgatcccggcaacaaacgccggtatcttggaaccgattaaacttggtacgccggtgtaaatgaacagcgctagcaccagcaacggtaaaccgcggaaaatataaataaatgtcgtcgccaccccgcgagcaaaccgattcggtaaaacacctaacaacccaaccaagatcccaacggcagtcgcaaagaaaatagccacaatggtcacgaccatggtttcccgcagcccgttcatcaaggtgccccagttttcccgcaataaacctagaaaactccgatcagtgtcttgggtcttggcgcttgtctgcttttgcgctgcttgtgtaccattgccaagatacttggcaacaatcttggcataagtaccatcagccttgacctttttcaagccggcgttaaacttttgatcaagttcgtcactgcgacctttttgagtggcaaagccgtaatagctggccttactttcaggtccggcaagtttgagcttcaaaccagtcgcaatggcatattgcaaaaccggcttatcatcaaaacaggccactgaattgccggtgatgacgtcttgatacatattattggaatcatcaaatgtcactgtgctgaagccatacttagacttcaggctcatcgcaaagtccgcggctgcggttccagtctttaaggcaacgcgtttaccgcgtaaatctttaagctggttaaccccgctgtttttcgcgactgccattgcgacggccgttttataatatggatcactcatcgcaaacttctgcttacgttccggcgtgatctgcatgccggcaatcaccccgtcaatctgatgggcttctaatgcctgcaccgctgcgttgaatcctaatggcttaatgtcgacacgaaatccttctgctttggcaattgcctgcatgagatcaatatcgatcccgacatactgattatgcttatcggcaaactcaaatggggcataagtgacatccgttccaatcacatatgttttcttcgccgcctgcgttgataccggcatcgccaagctcagtgtcagtatcaacgcagccaccccggctacgcaccacttccaaactcgtttcatgaaaacaccatctttctcatatttacttaacaccacgacaaatcaaccatcgtgatccggcagtggccctttatgactgagtcccaaaaacattttgccgtattcacagctaccaagtctaccgattttctgaaagcttgtccatgcgcactgagaagaagattgttttatactaagagaaactaataagaaaatgggatgaagccatgtttagctacctaattgattatgacctgaaactagcactacctcgtccggaaattgatggtccgcttttattcgagcaaatcgaaactagtcgcgattcgttaatggcttacctgccgtgggtcgccacaacgctaactgccgatgatgaaatcaatttcttaactgccaccttgaaaagcttcggtgaacaacgagcgctgcatttggtcattcaccaagctgataccccggttggtattatcagtctcaataccattgatcacacccttcatcataaggccgatatcggttactggctgacatcatctgcacgtggcaaaggtatcatgcataagtcagtcgaagccatggctgatattgcttttcatgactacgatcttaataagctgacactgaatgcagccgtcaccaacgacgccagcaatcacgtcgccgaaaaagccgggtttcatttggatggcattttacgtcaggaagatccgcatcacaatggcgactttcttgacgtgaacacctactccttgcttcgatcagaatggtcttaatgttccacgagaaacattaagtacttatttttcaaaacgggcacttattgaaaagtggcccacgaatcatttaaaaagcgaatgagtctccttaaactttaggagaactcattcgctttagtttatgttgccaaaaaagattgacactcggttcaagacaaacatccatcagctatcaatgaacaatcagtcgcaaaagtaccggggtcacaaaaccttcaatcaacgctgccactgcaatcattggtacgacgatgcaaacatattgtaaggcaatggctttgacatccagcggtgacttttcataatgagcatcagaaaagaaacgcttgatcgactggcgcagtgcacgattgacttgtgctgcaagggtcacaccaatgatcaaagcactcatttcaagaatgccgtgtggtagaatccccaaagcaaatgcggctagtgctccgctgagacccatcttggctgcataaacgcccatgactaagccgactgacgcacatgtcaccacatacgaaagccaataaagaaatggaatcgggatcatgcttattagcatcaggcccaaagcaacgcgttcattattaagcaagatcatccaaaaagcatggagattgtcttttggttctgcaaatttgtctgacaatccggtcacaatttggtgaataaacgccgggttcgcgtccatcacaatgtaggtaagtaagctcaccataatggtaatcgcaataaacaagagccagcctactaacaaataatgcccgataacatccaagtgatacgtcaaccgttttttcatatggtcccctccaatcagtctgcttatggggtcaggctatagtataccctacgctgaaataaggcgctattgagaagattaccgccaacaacatcagcatgggtttgactgattgcccacactgcagaaagaagcaaaaaggttgcccctgacggactcagcttgtgacttgctgtttctacaattttactgaataatggccgcatggaggtgtcgtgatcgtgatggaaatcagcgaagcacaagcaacttttaacgcagcgcgcaaacaggtcgaacaagtcgtcgttggtaaaccgatgccgattttgctggcatttaccgctttattagctggcggccatgtcttatttgaagatattcccggggttggtaaaaccaccctcgttcaaaccatcgccaaaaccttggacatacccttttcccggattcaatttacgcctgatatgctgcctagcgatgttctgggtacctcaatcttcaatcgggccaccaatgcatttgaatttcaacgcgggccaatcttcacaagcgttttgctggccgatgagatcaatcgcgccacaccaagaacccaagccgctttactggaagccatgggtgaaggccgagttactgtcgatggtcgcacttatccgcttccgcctgactttttcgtcatggcaacggagaatcccaccgattacgccggcacctatccgttaccagaggcgcaattagaccgtttcatgttacgcctatccctgggatatcccgatgcggccgcagaaaaaagtctctttgtcagtcctgatcggcaaaccatgattgcaaatttgaaacccgtccttgatgcggctagcttggctgcaactaaacaaatcgtaccaaccatcacagtcactgacgccattgccgattatgtcctgaagctggttcaagccacccgcgccgatcagcgaattcgactaggcatcagtccgcgtggtgggattgctttagtgtcagcagcaaaagcgtttgccctgctcaacggacgatccttcgtcaagccctctgacattcagcatttgatcattcccgtctttggccaccgcttgattcttaaagacccgactttaaaatcagccgatctgttaaccgagattcttcagcataccgccgctccaattcggaggtgaacccatgcattggcgtaacgtttttctgaacagtgcccttatcgccatttttgcctgcctaatctgttttggcatggcgtttaattcgccgacaagttggtttgtcagcgagtttgtgttcgtgttgttgctgctcctcgttcttcccttattactgccattgcgccggcgccttaagtttaccgctgacaatcccactttaattgccaaccggccagctcggcgtttctttactctgacccaaggcaaatggctgcctaatttaattttattagatgctgctaaaaccagcacttggcaccttcccagcggtcagcgaacagccagaatcacgttacaattaccccgcggtgtttatcgccaacttcctttcagcgtgaccgtgaccgattggtttggttggttccgcaaaacactacccttacagctcacagcgccgctaacagtgggccctgcccgtcagcctgaagctgctgcgcggatggccgaccattttgttcaaaaaatggccgcttcggaagcaggtctgccgagtgatcggatcaaaaatttccgtgattatttcccgggtgataacattcagcaaattgcttggaaaatcagtgcccacgctgattcattaatcgtgcacgatgatgaacatgaaagccagaccgcttggaccttgctgctcatcatcagtccttcgctatctgttgaagcgggactaagtttgtttgcaagcttaatggataccggaatctttagtggggtggctttttgctggatcagcggctcacgcgtatttttcgtggccaacaagatgctttgcttgcagggtttgaacctaagggcagtgccaatatcgaatggctgcatgacttatccaccccgggtcaccaacgcgcctacctaattctcgctgccgacactgcaaccgctatcccgtttcaacaagcacttgctccggcggtgacaaccgtggcaacactgtcaggaggtggcgaccatgcctaagtggctgcaacgacttttagcagttttgttatcatggtggctgcttgcgcttttcttagaaccttttgctgctatcaatccaatcgcccacccacgcgcattaatcgtctatatcctgatgatgagtctgattgactttttggccgtgctactaccgcgccaatggccatggtggctgctattgggctgcggcacgacaatcggtgggctttggggcgtactgccgctgaagcagccatttggcgtttcgtggttcacggcgtatttacacacctttaccagtgcaaccggaaaattcgtgcaggctggcggcgtcgatgttccaaccgtcctcagcatgacgctggtgatcacgttggtggcttttctgttgctgttaacggttgtggttcgtttctatcctggcgctattgccatcgttcttagttatctggtggccgtgcacatttttaacggcagcaaattaaccattcaattcattcagctcgctctagtaaccggtttattggcgatcctccacctttatgctgatcattggcgcccgttcttactgggatgtgtcttcataagcggactaacgcttggcctcgcttggctttcatcagcgaccccactaaatgatcagctggcaaatgtgtcgattccttttcgtgaccggttaaatcagcgtggtttttatgccggtattgagacttatatcaacggtcccggacgaacgggctttacggaaaatagccgcgttttgggaggaccggtctacgatgaccccactccggttttcacggcaaccagtgctaaagccagttattatcgcgttgccgttgatgcagaatataccggtactggttggcaggctggcgctgatcaaaaccagcgtatgccattagacggtgccaccatgcgcgactcggcggccactatcgattacgggcctgccacaagtacaaccttaactttcaacggtggtaaaacctatttaccgcttccttatggtcaattgaccttcaccggcggccaacccgatcccacgaccgattttttgctcaatccggaaacccgccgcatgcaaacaaccgaccaagcacgttttcagcgattggacattcaggtgcaaccaaaacagatctcagcagcacaattggccgcggcgaccagttcccgtcaaaaggttgcgtcccgttatctacaattgccacgcaccttgccaaaaagggtcagaacacttgccaagaaaatcaccgccaaggccacgaccccatacgaaaaggtactggctatccaaaattatctcaagtcagatccgcgcttcacgtattcaaaaaccgatgcacgccgcaccccgccaacccgagactatgtggattattttctttttgattcccccatcggttactgtgataacttctcctcggcaatggtcgtactatgtcgcagtatcggcttgccagcgcgctgggctaagggattcaacactggcacattgctcggtggttccggaaatcagaaaagatacgtgattcgcaacagtaatgcccattcatggccggaagtttatttcgacaacttaggctggctgccatttgaaccaacaccaggcttcagtgacccggcaactcccgatgaaaatgttacgcctccaagtcctagtaacagcggcactgaaagcgttcaaccgtccagcactagcaattcatcctcgtccagttcgcgtgtgtccgccagtacagtgtccaaacaaacgaaacgacaatctcggccgtctctcagccgcctaaattggctaaaaaaatcattgttcatcatcctattagctctactgttgataagtgtctggcagttaccagcgctcgtcatgctgatattaggaatcggactgggatcgacaaacttttcggcgcgttatcgcatacttcttcgggcgttacgttgggtcaagaaacgacccgtgaaccagtcgcttgatgattatgctcagaccatcgataaacgattaggccagcaagcgcatatgtttaacttaacgaaggcttatgaagaaaaggtttttggcaatctgcaggttaacacagccatattgcgacctcattggaaagcactcactaagcaacttgtacatgatcgttactggtggcagcgctcgaaaaaacataaatcatagcacgaggctgtttcacgtggaacactggacttgatctttaacaacacaagtcctagagcatcctttgcgccattttggaaaatcagcataaaagcccgcttccgatgacagcatctcaccataaagcgcgagcccgatgcagaaactgcatgtaagggacttagacgcaatggctaaaactgggctattacgtctgaggccgcttatgttctagcttacggccataacgcgctccccggcgcagaaacctgcgtgtaaggaccttaagcgcaatggccaaaacccggccatcacgcttaaggccgcttacactccggtttctaaacacgctggctcgcgctcactaaattgccggttacagtcgaaaagcaaaaaaattttcttgtgaattttcaatttaggttataagatagataagtaacgccttagcttacgttgcagttacacgtgaaacagaacgcaaacaattcagccacttatcataatcccttttttctaaatgaaacaagcgctcgaagcccttgataaatcaacggttgtgagaaaaacttgcacttactaataaaaagcgcgtatgataatataaacagtttctcaaaagaaccaaaaactgttatgaccccgctactatttttttagtagttgtgccacttcgactggacgctgcagtcagctcgtaacgtactcagaagaaaggggggagccgctgatcttagcggcgaacacttatgaaagttatgatcgttctagaaaatatcgtcatggatggcgttaaacgcgcttcaaccgttttaggtaacgacctcgtcaagcactacgatgttagtttttatactttagcagatgcccctgcctactttgagttggacgcacctctgctcatcgcaccgcgcccaaccgatcctaaacttttaaacttttttggtagtgacccatacacccactatcatgaccaaattgcggatttgatcacgacgattcgggatcagcattttcaaacagttatcttaccagcaggtttaacaacgagttttgctccgctgattaaacgggctttgccagacgttaatctcattggctggatgcacaataactacgctacttacatggaagattactatgtccagatgcaagctgagttcgaaggtggcttgcaagctgtcgatacactcgttacgttaaccgaaagcgatttgaattcctataagcgtttcaatccgcgtaccgttaaaatctacaatccgctcacccttgttcctactggtgaagctgatctaaacgcccaccgcatcgccttcaccggccgaatcgccatcgcccacaaaggaatcgactttttgcttgaggcagccgcttcacttccggacgactggaagatcgcaattgccggcgctggtaccgatgaagacatgaaaaacttctatgacctgatcgactactttaacgtcagtgacaagcttatttatcaaggaccgctaaaagatcaggctttgcgtgatcattaccgtgccgcttcaatcttcgtgtccacatcgcgttgggaaggcatgccgctggttatcggcgaagctatggcctcagggttaccggttgttgccatggaaaataccggttcccgcgaataccttggcaacaacgactatggcctgctgaccaaagcgcaggatgtcccggattttgtggctaacctcaagaaaatgattaaccaaaccgatttgcgccggcactatgcccatcaaagtttggaacgcgccagccactttagcccggaaaacattgtgtcgcagtggatgccgattattgagcaccaaccaacacacgtctcaattgccggatagttagcagtacagttctccaaaagttaccaggcttcatcaaaaaagcactcacggaaaattgaagtgccccataattgttagacagatactctaatgatagtggggtatttttatgactaaatattcaagtgagttcaaggtgaaggttgtacaggagtatctttctggacgggtttcctataacagcctttgcactaaatacagtatcccgtcaacgaaaccagtccgagagtgggttaagcaagcccaagtccatggacttgaatctcttcagcgaaagcatacgaagacattttattctctggaacagaagctggccgtggtagactattaccaaaccagtggtgcgggtgtggtatctgcggctgctcatttcgggatcaatgcctcgcaggtggctgtctggatgaagatcttcaagactgagggagtggctgggttgcgtccgaaaccgcgaggaaggcggtctacagtgaaacataagaaacccaaacaagttaagaagcttgagcttagtgagaaggaagcttaccagcaagagatcctgaaattacgcggcgagttataccatacgcgaatggagcgtgactttttaaaaaaattaggggccgtatcgaagaacaatctgccgcccaaaaaacagcagtagttgacgcgttacggcatgactatccattgaaggaattattggcattggcacagttgcctcgggctactttctatgaccgcttgcaccgcaagaataagccggataaatatgccgccttgaaggtatttatcaagaagaccttccatgactcatatgagacctatggctatcgccgtattcatgtgatggcacgaaaagccggctttaaatgctcacccaatacaattctacggttaatggggcaattgaatcttagtgtcacactgtattctcgccatactagcggctatcactcctataagggaaaagtaggcaccgtgaacgacaacctgttacaccaacaattcgatgcccaggagcccttcgctgtcctgcacaccgacgtaacgcaagtcagactgcttgaccacagctggggctatatctcggccatcattgacgaggccagtcgagaggttattacagtcattgtgcgcaactctgcgaacaaagaacaactccacctaacgcttgacgatttggccaagaaactccccgctggcgtcacacccatcatgcactctgaccaagggtggcaataccaaacccgtgaataccagtctcaggtgcacgccatgggcatcgttcccagcatgtctcgtaaaggtaattgccatgataacgcaccaatggaaagcttcttcaacctactcaaacgagaacggctcaatcggcaaccaatcaaggatcttgaggaactgaagcaaatcgtagatcattacgtcacgtggtttaatcatgaccgtatttcactcaataaaaatggcctgaccccgattgaatatcggaatcagaccgctgcgtaactaattttccaactgtctaacttttttgttgcacttcaaatccgcgggtgcttttttgagtgaattagattatagaaagcttgtacgttccacgtgaaacctattgttgatgacaaaaagttccacatgaaacacctaaaccgaggatgcttgtttcatgtggaacagttgtgtcacttggcaggaaatcacatcaattcttaccgaccgcagctgctttaggaattggctcttggtttgtcatgactgctggtgagaacagtcgcttgatcaactcatctggcagttggtgctgccggcgaagaagttcaggaatggcaatgtgggttttaagactggtcttaacgagtttagttgtcgcttcatagcctaggtacggactaagaatcgttgcgctaatcgccgagtgttgcacattttcatcagactgcgcttcgttaacggttaatccagtcacgcaattcgttgtcaaggtgtcaatgcctcgggctaaatagcgctcgccttgcaacaagtcacggaaaataatcggctcaaaggcatttagttccaactgccctgcttctgctgccatactaatcgttaaatcctgcccgataacctgaaaagcaatctgattgacgacctcagggataaccggattcaccttccccggcataatcgacgaccctgcttgtttcgctggcaaatgaagctcattcaacccagcttgcgggccactgctcagcaaccgcaaatcgttagcaaacttagataaatccgtcgccaaccctttcattgctccggaaaaggcaactaagacatcacaattctgagtggcatcgatcaaatcatcagctgattcaagctttaagtcaatgagccggttaacctgggacacaatgtgcgcgcgataataaggagtcgcgttcaacccggtaccgattgccgtcccccctaaattgacctggcgtaaatcttccgccgctcgcgtcagccgtttttggtcgcgctggaacaaactggcatacgcatgaaaactatgaccgaatgtagttggcactgcatcctgcaattgtgtgcgcccgactttaaccacgttcgcaaactcgtccgctttgaccaacaacgacttaattaaaaaggtcaaggcttgctgcaatggcggtaaagcttgcaaagcagccattttcccagctgtgggataagtatcattcgttgactgactctggttcacatcgtcattcgggtgcaccggctcagcggtatgctgactggccaagttggcaatgacctcgttaacattcatattaaccgaagtcccggcacttccttgaatcgccggcgccaccagtgcatcacgatgttcacccatcaacaagctgttacatgccgcaacaattgctttcgctttagcggctgacaatgtcccgccagcagcattcacttgcgccgccgcctttttaatgataatcagacttttaaaaagcaaagcatcggtccgttcatgactaattggaaaattcgccagtgcgcgggtcgtgtggatcccatataaaacatcctcatctactgccagcttgccaatacaatcttcctcgatacgcattgtgaactccctttcatataccaatatttacgttcttagtatatgcgtgttccaacaagcgtcaacgtttaatgtgagctagtctaacaagtacatcaaaaagtataccaattaagaaatctttttgtcatcttagtgatcgcgatttaccttgtcgaaatcggcaagcgcccgccatcgttccactggccaatcatttgatgcgcctgacatgcattggcaaattttgtcagacgtcggcgaaataatgttggctggtgactttttatttgaatcgtgtcacaccgaactcgccgataaagcgccggacatgattcaaaaaatgcccacgctccgggacgccgcttgagtgcgcgaataattctgggatctatcttaaacccgcttggatcgagatcaggtaaccgcgcatagccagccgccgtcatttttcctaaccgaatcatgcgacggcaacgctctttatttaactctgaccacgcacttcccggctgccgcggaacaaacctttgtgacgccggttgatctggcgccagtttcttgtaggtactgtcgatccacccgaaacacaacgcctcttcgacagcatccacataccaaaatgtgccatcagctttcggaatgccacgtttaacgtccacccagcattctgacgcatcttgattatgcatcgccagccaagcccgaaactgctgccggtttgtaacggttaaatgattcataaccactgtttaagcctcttttttaaataacgcaaaagataacaaaagattctacgcaacagcgttaagctcacgtagaatctttgtttttccgattaattaaaacccagctactaatgtccgcgatgtttcgctaatcgtttggtttgtttcttcaagcgaacctcgctggcatgctgatctttcaactgctttcgcctttgcttcttaagtttcaagttttgcttatgttccagcttcagaagcgtcgttgctttgccttttcgcaaacgctgaacttctttgcgtgcttgccgactccgccttttaggactcattccgttctgaacctttggcaaagcgtcagcctcacccgcagcccaatgcaacttgccccatcgctgttgaaccaactgcaacaattcgtttgctgtcggagcttgagtaccaaacgtaacttttgcaacacgataagtatcgccacaattctgctcaaatagcccccgataaaaaggcgattcaaaatacactgttagcttgccttgaatgatcaaactaacacctcctttatttttaaccctatccggacatccaaggaggaaggatactgacggcccaagccgcgtctggagtaccaaccagactgtgtttttgatagcgcagtgttattgtctgactttactagaatcctgtcaaattttgcagaagaaaagaaagatgactaaacagtggacagccaagggcgttacatctgatattaagaacatttctaacttcttaacagtagcgcctatgacttaagaaccctcgtgacagcaatcacctctacttcactctttatggattattgttttccaaaactatatataacttttccaaacttttaaatgacataaagttggacaaatccaaggaagcatcacccttaacaacgaccttctcagaaacgatgccacgcaagacgttatcgagagcacgctgcgtaaacatcttttcttcctgaagactttgtatgcggagaacaagtgccttcagtcgcttgttttttctatgaatgactacaaagcaaattaaagggccaatagataaaactgctacaatcaggaaagccgcaattaagtgattcatattcgaacagctcgcttctataagattaaaaccggacaacccggggacggcagcattgccgaaacctgagccttacttttcgatcttcattgtctaccgtgcaggctttttcaaattcttggaaaatataacaactagaaaaacaagtatggacaaagcgaaaagtattcgtaatccttcaaaagtaaataattctccatcttcaaagagttgatgaagattaataaactcaaacataaaaagtaaacccagcggcccaaaaaccgctcgtctttttcgttctatttcactgtgcgcgaatccatcttgagatttaaccttatgatcatcactgagtgccacacttatccctccctacaggtataagcataacaaaggcggtcatcatttgatccaacaacatttaaacgtagggatttcggcatttaacgttcatttcagctaaagttacgcgacaaattcctttttcacctaatctacgtgtatctgtcttaattcttatagataacgccaagcaaaaagcccccgtacgcaatcgtcaccgatcttgtaaggaggcttctaaattgatttctaggctttcgctgttgcttttgccgcgttccgaacgctttctgctaccacttcggcaacatccccgtcaaacgcattggcaatgatgttcgtggttgacaattcatcatccggtatcaaactggcaatccctttagccgcggcaatctgcatgtcgatcgtaattttgcgtgccctagcatccagagcgccgcggaagatgcctgggaaagcgagcacattgttgatctggttagcaaaatcactgcgcccggttccgacaatatatgcgccagccgccaacgcttcatccggaaaaatttccggctccggattggccatggcgaaaataatcggtttaggtgccatggttttgatccacgctggattaagaacgtgcggcgccgataccccaacaaagacgtccgcacctttcaaggcatcttctaacgtcccggtgcggttttcccgattcgttatcttagcaatcgccgcatgatgtggtggcagttgatcagcgttctttttagctaaaatgcccaccttatccaccaccatgacgtgtttgactccggctgccaagaatcgccgggcaacggatagccccgctgagccgccgccattaaccaccacgcgaatgtcttcaatctttttatccgctactttcaaggcattgtacaaagcggcgagcaccacaatcgcagtgccatgttgatcatcgtggaacaccgggatgttgagctcatcaatgagtcgtgcttcgatttcaaaacatcgtggcgcactgatatcctaaagattgatcccgccaaatgttggtgcaatggctttaaccgccgcaatgattgcttcagtgtcttgcgtatccaacacaatcggcacggcatcaaccttagcaaaccgtttgaacaaagcggcttttccttccatcaccggcatcgcagcctcggcaccgatattgcctaaccctaaaaccgccgaaccgtcactgacaactgcaaccgtatttttcttagtggttaagtcataaacgagcgactgatccttggcaatagcagaagaaactgccccgacgcctggagtatacgcaatactcaaatcatcgcgcgtctcaattggtactttcggttccacactcaattttccgccatttacttttgcttgatctagcgctagttgattaaaatccttctttgccatgtgaatcatcctccttaagtttcgaaactagtcgatttaaaagatcatccgcagaatcgccgtcatggtaataacggtaatcgcgccacccaagcgtgttgccacctgagcaaatggcatcagattcatccgattcgccgtactgagaatagccacgtcgccagtaccgcccatcccactctgacaagccgtcacaatagccgtttcaaccggattcatgttcaggaaccgcgctacgaagaaaccggtggaaaccacagtgagcaccacactgataaccacgataaaatattgccaactcaacatgccaacaacatcttttagcggaatgtatagtaaacccagtcccgccatcaacggaaacgtaaaattactggaaataaacttgtataactgtttggcacctcgttgggtttcacccggaatgacattgacatatttcagaatcgccgcggcaacaatcatcaaaaccggccctggaaatccggtcactgattgcaacaacatccctaaaatgaacaaggtacatgccgtgaaaacgcctgcgcccatcatttttagatcaagcggtcccgtatcgtctttcaacgcgtctgccaagtcatcttctgccccattcagtcgaaccaactgtccctgccccgataactccggacgtttctctcccaaccgattcaataaacctgaacacataatggcaaagaagttaccgataatcgttgccggaattaactgagccacaagcgcgccgctggtcgtccctgtgatcgtgctgtatcctagagacagcggcaagatgccttccccgatgccgccagccaaaaccggcgtcacgatgaagaacaacgtatgcttccactccagacccaataacacgccaaccaaagtacccacacccatcgccagaatcatgccaagcatcatgggaataatcatccgcatcaacccttgaatcaggatcttgcggttcatccccaaaatgctcccacagactagacatgcaatatagaaataaagaaagtttgcttgcttcatcaacatgtcagttgcttttaacacattcggattcagggcgttataaaacacaaggatcgatgggactaacaacgacagtatggctggcccgccgaaattcttaaccaccggaatgttggcaccaattgtccctaacaaccagcccatcgtcagaatcactgcaaagccaccaagcatattgaccggcagctgctgcatcgcgccggcaaggatgatcaccatggccatcaccagataaactggcaacggcacggaaccaatcctgatcgccatccacttactttgtgaactttctggtgcgctaggtgttcccgttttactcgccattttctttccccccttaggactcttactatctgcagcataatgtaagcgctttaaatagtgaagattatttaacttttttaagcatcaaagcatttatttaagccattattgcgtgattcacaagcaataacttctgatggaggaaggtgaaaggcttgaaaataaaaggatggcgcctctggggttggctatcactcatcttcacctcaactttattggtgacggttttcacagtctatggcttcaccttattggaaaatcgccagcagttcgagacgcgtgaaagtcaacttttactgtcagtcggccgccaattggctcaagaaccacgtgtcatttctgcgcttaaggccaataaggctgatccggcaacgcgcgcttacgccaattctgttgccaaaaacttcaaactcgactttgttgtcatcatgaacatgcaagcgattcgcctcacccatcctgatcccaagcagattaaccgccatttccgaggtggggatgaggttcgcgccttgcagggacacgcctatgtttctgtgcaacgcggaaccctagggcgctccttacgcgggtttgttcctgtctaccaaaaccgcaaacaaattggggtggtggcactcggcattaaagtcacagccttacaaatgctcattcataactcccaaaacggctttcgcttggcattgctagtcggcatcgttatgggcatcctcatcgcctttttggtggcttattacattaagcggcaactacacgatcttgagcctaaagaaattgctcggttgcttgaggaacgtaatgccatgctggaagaaaccaaagatccggtaattgttgtggatctcaaccagacgattgtgctagttaatagagctgccagcaaactgcagcgccacctcattcatgaacaagcatttattggccggccgttaaccactttaattgcccatccggaacgcattaagctgacggtcaagaccgagcagttttatcagcaagatggtcaggattatctgttctcagccgcgccgattatcgtgaagaagcaaaaaatcggttacgttatctttttacgcaacgccactgaagccattttcgttgccgatcagttggcgaacaccacagcttatgccaacgcactgcaaagccaatcccatgagtttatgaacaaactgcacgttatttacggattggtcgcgatcaaacagtacgatgaattggcgatttatttacaagaccttttgaaaccggaacaagaatttgctaatcgcctcgcattattagtaaaaaatccgctcgtagctgggttcatgattggcgaacgcgagaaatttgccgaacgtaaaacaacgctcaactttgaaatcgtgccagaactgcctgccaatcccaatgttagcgaaactaaatcacttttaaccgtcagccgttatctgcactttggtcttttacagcaagatttgcctgcgaccattctaattcagctcgattatgctcagaaccaactgaccatcacctatcatctagcacaaccgcttagccgtaacacgttgttgtcagtgattcatcaagattacttccaacaattactttctgatttgcatggcacagccaccctaagtccaaccgacccacttgtgttgactttggtggtggactaccacgaggaggcaaaaaaatgaccaacattctcatcgttgaagacgatcccatggtgcaatttattcatcgcaactatctggaaaagcttggcacttttgagacgatttactcgtcggagaccattgccgaggccaaaaaactgctggcaacccgttcgattcaactcattctcttagatattcgcctaaaagatggtaatgggatcgactttttaactgaactacgccgcaccaagcaaatggttgatgttattttaatcaccgcagccaatgaagtcgaaatcgtgaatgacgccttacatctaggtgtcatcgattaccttatcaaacctttcacgatggaacgcttcgaaaaaagcatccagcgttttaaaacgaaaaatcaagcgctggtcagtcagcaattgaaccaaagtcaacttgatgcttatttagaaccacacacgcacgcttcttccattcgcgacttggataaaggtctaagcaaagcaactttggaaatgattcaagccgcaattcaacaactgccatcatcttttacggtcgcacaattaaccgctgaaaccggcttgtcgcatgtctcggttcgaaagtatctaaactttttggaggatcatcgcttcctgaaaagtgatacgatttaccgcaagaccggccgtccattcaagacttaccaagtgatagcgccattaccgatgctgtcgtaacttaatccggaagacttcagtacggctagttgatggttagctcagtgcctttctataacgcgcccacataaaaaacgttaacgtcaatcaaactgaatagttgatcacgttaacgcttttaatattggacgaggtgcttttttgactgattttttgaccactgacgatgcttgctcgcttaccgattagtgactcgtgaccatattagtgaagacccgtgatgtgataaccggatcgtccttagtcttctgcgattgtgccgacgttcgccaatggtaacgatctaacggtttcacctgaatctggtgcgtttgcggatgcttcttctgcatccctttcaacgtgcgataccagctatgctcacctgttttcaaatcgattaatgcatagccttcaccatttatgccagactttcgaaaatcatagttatgatcttcttttgacttcacaaccaacattcggcgattccaccccaccgcctgcacatgataaagcaacgtgttggcgtcagtagttgtttgaagctttcgcgggatccgttcgattagaaaaggcccaacgccggattttgtgatttcaaaatgccgaggcagtttgattgaaaagccttctgcatcggctccgggatcacgtttgttctttggaccataaaggctcgtcgcaatcgagctgactgttaacaaaacacttaatccgatcatcgctgatattgccaccaatgttctctttttcaagtgtttcctcccgtttgatctagctaagtcgttcgttcaaaatatgttgatttcagtataatatctcttttcggtgccctaccgttatcagtttgaaaattatagaaacttcagaattttttgtaaatgattccaacccagtttcacgtgaaacaccctcaaaactttaaatgcttttaccgaataaacctttaaaatgatgggagagaaaacctttgcttaatacgaaggctctaaaactgtatatgttttcttcaacgataggtatagtcatgtggttaaagcactcattaacatcccaatctattggggtcgcagtttctctgaatttaggttacattttctttctaatcggtggcatatttcaaaaacccaagttggtcgtggccagttccttcctcatcatctatggaaatttggggtttgttaagcaagtaaatggcgatgcaggccattccttctcaaaagttgcctctcttttaatcatcattctttgccttataacgttttatctgctgaaaacaaacactttgtcgttccttatacccttggtttcactaataataaatggggctttagtcagtataaaaacccatgatcagaattgatgagctctcttaagccgaacgatcaaaatgaaatggccgcggctttttatttttctgatttagaaaaagggttcttttacacccgtttgaacataaaccatttgcaagtgcggaactggtcaacatcacgatcaggaacttttacaccaaggatttacgttaagcattaatacaaccaaaaaaagagaccccttttgcgtgaaagagttgtccctttttcgatatatcatgattattccgaagcatttggcagcgccgtcttcttattggtaatatcaataaacttcgcctcgccgtcaactgaatcaaccgctttttgcaggcgtttcatggccgccgtggcgattggcaagtcgacaaattccttggtcgcgttgtctaattcgacttcatcagcaaccgagtctttgagtggccgcggattgctttcgtctagtgctcggagtacgactggcttaagtggtcccatctgtaacaattcgagcgtggtttcatagtcaatgccgtatgcatcagctaaatccaaggtttcgcgaatgccggcttcggctgccataatcgcaacattggtgatcaattttagcttagcgccgttgccttggtcactaacatacctgatcttgccaaaggtctccaaaaccggcgcaactgtctctaccacttgcttgtcaccagctgcaatcagcaccagactggcttcacgagcatatttcaccccgccgatcatcggcacatctagcaaagtcgcatgtgctggcatggcactttgaatcgcggtgatttttcgaggatccaatgttgaagtgacaatcagcgtgctgcccggctgtaaataatggacaattcccgggtcatctaccgtcccgatatgcaatgctggcacatcagctgacatgaccgacgtgataatgattttagaagcggtcaccgcatcttccagtgaggtcgccgcccgaacatgatctcctgccagtgccgtcattttagccggttctttgtcccaaatcacgacatcataaccagcctgggccaaatgcggcacgatctgactacccatatcgccaacatcgataaatgttattttcatggctgttttcctttcaatttaaggctaagctcccaacaaaattattaaaaggttgcaataacttccagcaataaaaagataaaacatttgtgcataatcatcacgcaaccgggcgaatcatttgccacggtatcaccttcaaattagcatgattaaaagccgatttcaaaaacaaagctcacctgctggatttaattttgccaagacgcaaaaaacgctgcctcgcgccgattagttatttttaaaatccacttatttggcgatccttattttttcgtagctaaagatcggcgtaccctgcgtttttgccgtatcagccagattactctggtgccttgcctgacacgcgcgtcagactcacggtcaaaacattgtccttggtcgtgttatagtcagccaaaattcccttcacaacgccttgcgaaggtccatgcgttcgggttgtttcttcataattttgaatccacgtactgaccgcattgaagccgaattcaaacccttcaaacacctgcatgtaaaccgatgagcgcggattggtcgcgatgatcgtaatttttttgacgcggccattttcaatttgcatggtcaagttgatgagctcgtcagcaattaaagtcacggttccattttcagcagttcgcggtaatttataagccgccaagcgcatattagcgttatacacccgctgaacataagcataactccccaggtcttcgtgcatgattttcactgcccttcacttgtgtcagtcaacagctggcctacgcattctgatctgctgcgccccgttatttaatagtgtacaatttatctttaaaaaggagaaataaacagctcggtagtcaatccttaaagaaaaagccgcctcttcactgagacgactctttcaaattctattttgttggcgtagttatgaaatccagcatacggaagatggctaagcggttagcctctggtggatcaacgcgcataatttctgcggccgtttgatgtaaagcgttatcgtctaaagcataagccgcatcgttaattgctatttcgcgaacatcatcagcttgcggttccagatgaaactgtaaaccaattacatgatcaccaagtaaatagccttggttttttaacaattcattactgaataacaacgtcgcttcatccggaacttgaaacatttcttcgtgccaatgcaaagccagcaacgaatctggtaaaccgggaatcatatgcgtttgtagatgtacaggcgcccaaccaacctctttagccggtgctttgctaactttatagcccatcgtctttacgatttgttgcgcgccataacaagcaccaaagattggtttatgctggctcaacagtgtcttaataagacgacgctctgccttaatccaatcaatatcgtcatttgggctcatcggtcctcctaaaacaaccaacaaatctgtttcagaagcggttggtaatgtgccgtcaaattgataaggatggtaaacgtaaagctcatgtccgtaaaaatctgcccaagtcttaatagcccccggaccttcattgggagtgtgttgcaaaacgttaattcgcattttaaatcctttcacatctccggcaatgtttgatttgggtttcgcctgcaattacccaagatgatttatcttaacacttactcaggaatttttatatctcaaaaagcaagtgacgagttacgcttacatctttgcagccagtacggtaatcttttttccatcacacaagctactgtgattagcgattaatcgaccgcgccatccgctgaatcgtatgccgttccccacgaattgctttgctgacggcgtataaattgtcgaccggcgactcaaaaccccacgcagaatcgccgacatgttgcatatcgacaccgcagattttgttgcgaattgccattgcctgcaacacccgactgccgctgccttcctgactagtaccgatcgcactcatgaccaagccgcctaactgatgaaccactttcacgacttcggttaattcggcttcgtcaaatcccggcactgagccaactgctggtgctaaaatcacatcggctcctgcttcgataaagtctttggccgtttctgctgtcataatccgttcatcaactccggaagcatgcattttacccgcaataatcaagccgctgaagtattgcttggccacggtaatgctatggataatcgcttcattagtgacccccgtgcccggattcccggttagaaccatgaactgaaaacccattgcttctgcttttttgatgacagcctcacttgcggtacagccgggtaaaatcgcaatctgttgttccatcatgttaggatgatcgccaatcggttcaagattaatccccactggccgcccaaccaatttcttcaatcggtcaatgctcgctttgccatcatgcttaggcgcagcagcaagatgccgttcacccggataaagaccgaaaattttcggatcattcacatccaaccgattacacaaaatcatatccgccccaaaagcagccgcaatttctgccgtcgtaatgctatccagattctcttgcgtcacgatattttcactcacaataattcggccttcactggctttgatgctttctttcaactgctgcccattaaactgcatgacttcactggtactggcactcaacaatcgtttcaccatgactgtaaacctccaaatttattaaaaagttagttcaacctttgatatcatcattatacttccgccgctgcttcgatttcgtcttcgtcaaacattgattcgtcaacgccccagaagaaaaatccagtagtgtcaccgactaaatgcaaaaatgtttattcacttcagcaacaaaaaaaatcacgacccgcaagcatattttatacttacgaatcgtgatttttttatctattctgggtggtcaggggaaacgtaactgttttacatgaaacgccttaaccatgcaccctagagctattaccaaccatccttaaaacccccgtggttttctctgtggttttctaattcaattttgcatatatttagcaagtgccgcggtggcctctgattcctgctttgcactgacgtgagcatacacaccaagcgtaatagtcggatctgtgtgccctaccagtttttgtactgacgtaacaggaacaccagcaatcagtaaattagatataaagctatgcctgaacccgtgaatggttattctaggtgtaagtccattgtcatcttgcagcttatgcagtcgcttagacggtgtgtttaatgactgatacccgtttttagtattagtgaaaagcaattgattcggttgcatcgtattaatacctagttgtaggaatgtttcctgctgtattctacgccaccgtttcaagtatgccatcgtttgaccgtctaccggaatggtgcgccgtccagcgcgtgtttttggtgcctgaacgatctggtggcctttatcaccttgcgttagtgttttgttcactttgatactgttttctttaaaacttacatcattccacgtcagcgctagtagttcaccacggcgaacccctgtaaaggctaaaaccctaaacatgatgaagacatcgaagtggttctcttggtcgatacaggcaaagaagtgattcatttgttccttagtccaaaagttttcaggcttatcaccagccagatcgtcatggtgcggtaaaacaacggctttggcgggattcttactcatatacccttgtcggactgcgtagtccataaccgatgaaacatagttataccagcgcttatagttagcagaggtgaactcaaaccacctcttaacagccttctgtacgtccttagtggttatagtagcgatccgcttaccaccaaatgccggtaggatgtgattattgaacataccagcagttcgagcccacgttgattcccttactgtattaatgtagtttccataccactcctcatacacatcccgaaagaacacgggctttggtttctcttcttctaagtcaccgttgctgattgctagctcaagtctagctgctgcaacagtggcttctttttttgtcttaaaccctcgccgcaccttgtacttcttgtggccagtctgtagatcattaccagcaaagacctgaacgcgccagaactctttgccgtctttcgttgcgtactttttaattgatgccatattcttctcctatccgtcacgctgggcaggcggtgttagatagaatttttggcggccgaattttcggccatgatattaatcacattgcttctatgaaacaaaattagttctattgtgctattcgtagtcctggattttttgagtgggacttttttgagatatatcaattatatctgacagttcttttgcaaaatctgtcttcatttcttcaatctgatcggcggaataatcgtgcgtccgtgctctaattatccccgcaactatgctggaaaatttcataatcgccacgttctgtctttcaggcttcatgagttgaacaaacctcatcgaattttccaaaaaagttttttcttgccaagttaacttttttacataatcatctgaaaacagttcagtccacaagttttcggaattaacttccaaattatgaagccactcatctctctgcttacgtagctccatctgctgatcctctggaagatcttcaaaagccggtttccctgtaactaagaactggacggaaattccaccatggttggcaatttttttcattgtatctgctgacggtgcagagagaccccgttcccatctcgatactgctgattttcctgaacttgttaatccaaccgaaagtgcgaactcttccatggtctcacctttagaaatcctgatgcttttaatcctttctccaagggaaagatggctgtttggctccaatagttttgtcatttcagatcatctcctaaaaagttgatgcatgttgttgactccagtatgagtccgtggcatactaaagtcaatcagttgatgaatgttgacgtcaacagaaaggagcgtgctattatgcaacgtattaaaggttaccgtgtaatgctaaatttaagtcaacaagatgttgccaaagaactcggtatctcgcgtcagtcttactggagcaaagagaatggtagaacatcgttcaatgataaagagaagacaaaaatccgagatcttttcaggaaaaccggtattccagtaacgattgattctcttttttttgacggaaaagttgactaatgttgattttggaggtgaaggaacatggctttaatgaaagcgcaaattacattaccagccgactttgatcaaattttacaggaacgaattcatcgagaagttgtccgcgtgatgaacgagactaagcagcagccgatgcaaaaaaagctgaatatcgggcaagcagcagcttatgccggtgttgctcgtaacacgctgctgtcttggactaagaaagggttgttggtacaggttgtcggtggcgtaaaacgtatcaataccgcagacatagacgattacatgaataaccacggcaagtaatcacgctgggcaggcggcaaattgtaagcaacttatgacaggcgcataaagccagagaggaaacattatgaatttgtttagtaaagaagagatagcactagatcacgagcttggaaatttgattgacgacattcagcttaacgttcatgccattgcagaagacagtactgtcacggttgatggcaagtatatttccaatagcgagttggccgttacgactgcaaaagagctgctgcgggtatcggaaatcctaaagctgtatgaaaacgaggacgatgccgatgactagccttattgcgtggctactaagccaccctataacagttccagcactctgcatggctttcatggtcgggagcgtgtttggagcgtatctgcaatttcgagaggatgatgaccatggcacgaatggctagcacaaggctcggctttcagtggcatgactacgtccaagctgatgcagaatgtgatcgatactgggcgtttaaaaaagctgaacgtcgttcactacatgaagccacaaaaaaatcgccaagagtggtacctcaaggcgagaagaagacaagcgaaaaaatctatatcgacttttagcttgcctctaagtggttactttgtcaaggaaaatggaggcaattatgatgaaaaatgtttcaaatagcaccaaagcgcctgatttaggtgaggcgtcttttgacctcagcactgcaaaaggacttctagaagcccttcgtgatcagttcgacactatggaaggttctgtagtttcatatcgaaacaatcgtaccgaaaatgctgcaatcttggcgtacagtacgaatcgatcattttatacatggatggcgctactgaaagcaattcaagaatacgttgaaagcagcctggcaacgattgatgaggtaaacaaatgatgaaggaagattactatacaaccgcacaggcgcttttgagcgatacaagtgcaatggtgaatatcttgcgacatcagattaacgatgaacagcaatcagcgctggccgacacagtcgctgatatgatcattgatgctcgccgtctacttttggaaggagatgtggccgatggtagacgtgcttaaagtagcgcttggttatcagcaacacggctttgcagtctatccccttgcgccagagacacgaacaccacttgctggttcgcatgggtacaaagatgccaccaaagacccagaacaggccaagaaatggtggggcgaacatcctaattacaatattggcttaggacttgatggcgtgctggtattcgatatcgatatggggcataaaagcggggctaatggcaatgatacgctggctaaattgagtgctgagggtcgtgctgatcaaatcccatctacctatatagaaacaacgccaaacggtggacttcatattttcttcacctatcccaaggaattgaagctaaccagtcgatcagatctgttctctaagaatggcgagaaaaccggccttgactatattgcaactggtgtgccggtttttcctagcattcgcgagaacggcatgtatcaaccactcaaagggcacaagatcaccaagctagccccagtgcctcaatggttactagatgaaattcaacgtgtcagccaccctaacccagtgtttggtggttcaacagtttatcgaggtaaacgatggacgggcaagctgctagatgaaatagtgaatggcactagtaccggcaatcgcaatgattttctgaccaagattgctggcaaaatgttcttcacaggtgcagagccgcagacagtttataacttgctgtttacaactaatgataactatctagatacacccttggcagaatccgaagttaataagattttcaagtcagtattgaaagccgaagagaggaggcgtgcggttggttaaagcgatgcccgaagatattaagcaagaagccaataaagtggtcaacgttgattttacaggtcaagagcaatggcgaaatgaccttaaacttgatggcaatggtgggattagaaaagactcggtggttaatattcaactgctacttgataatgatcaagccttcgccaatgtcgttgcttgggacgacttttcagagatgctcatcaagacaaaaggcgttaaaggattgccgattcgtaagggtttttggactgatgaagatgatgctgtcgtccgctcatatatggagcgtaagcacaatctcttgtttagcaagcagaatgagcaagatgccatggttgttgttggcaaggaacattcaattaatccggttaaagactggatcgaagctgagcaatgggacggtacccctagagcagaacgttacttcatcgactatctaggtgccgaggatagtgaatatacccgtgctgttactcgtaaatggttagctggggctgtaaaacgtgtctatcagccgggttgcaagtttgaactcgttccaattcttgaaggtaaacaaggacttggtaagagcacggctgctcgtaacttatttccgacaaagttcagcgattcattaaaatcaatgggcaagacagacgaagattacaagaagctgcaaggtaactggatcatggaactcggtgaactttccgcaatgaaaaaaactgagattgagtcagctaagagcttcatcagcgcccagtcagattcataccgcgggagttatagccactatgtttatccacatttacgcaagtgcgtgttcattggtagcactaatcaacaggactacttgaaagacgctactggtgaacgccgtttcttccctatcagatgcggtgttacaaagcccacaaagaccgtatggcgcaatgaagaaagcgtaccgaagatcaaccacgatatacatcaggtactggcagaggtaaaaacatgggtggatgcaggtgagagtgtctttgctgatgataagctgatgcaactggctaaaccatatcaacaagaagcagagacagttgaccctatgaaagaggccattgaagactttctcaacatgaaagtgccatcgaattgggaaaatctgtcattgagcctaaaggccagcttctttcacactcatattgaccataacggcgatgttgccacttggttacaacagcacttggatgctggagaattacaaccactgcaacaaaccacgaccagagagatcatggaagtggtgttcgacaagtcagtcgatcgttacctaatgggccgtactggatcggaagcaaaacgtatcaagctcatcatggataacatggatgggtgggatcgtgaacgagttcgaatcaatggtcagcgttcaagaggatacgtcaggaagtaaagtgtttgtttttctactgtcccacctgtcccagtgctacaaatgccggtatatcaacgttttgctgggacaagtcacctgtcccagtgctgtcccaacgtgtcccactactgtcccaagtcctaatttggacatgtgcgggacagctcgggacagctcgggacatgtgtgggacatgtctgttgtcccagaaaaacgcctacataccaacgtttataagcccgggacacgtgggacacttaaaaaacaaacaaatttaaaactgtggaggttaaaacaatgctatatccagaaagcacatgggctaggtttgaacaagaattccctatccctgagaagtatcgcaaatactatgagtacaagaattggcacattgaacctaagtcatctgatctcagccagtttgaacaggatcatccattcgcgtttatgttgatgcctgaggacatgcagaacgctttatatctctggactaagggactggccaagcgaaagacaatcaacagcgactatacctcatacggtatcaagcacctattcactgacttacccggtggcttctacatcactaacggcatgatgaaaggcgcactattggcagctggatttgagatagccgactacgccgagcttaactggcgtgccaacatttcagggcgaagcatcaaagagcagatcaaattagcacctcatatcagttagcaaagaaatattattaatgaaagcgaagtgatgcaaatgagtgtgcctttgcacatttgcatgcaccccgggtgtcgtcgcatgatcccgttcaatcagcgtttttgcgaggagcataagcaagacaagagcaaacaagcgacgaatcaggaacgcatgcaatacgaagagaaggaattacgtttctacaagtcaacaacatggacaaagctttcaaagtcattcaggttgcgcaatccaacttgtgctagctgtttgaaacgtgggattattcgtcaagctgtgcttgttgatcatattgagccaatcaaaacagcttatggttggcaacacaggcttgatgagagcaatttacaaagcttatgtcagacttgtcataacgctaagaccgcacgggaggtagcacaacgccgaatgagatcccccgacagatcgacccccgccccaaaattttagagcgaaagaacggtcggcctcttttcttttcgatgaataccgaaaatcatagaacctaggtataatcaatatgttataattataatagatataaacgaatacaaattcagaaaggacgttacacatgggagcacccctaaaatcagtgactaacctaagtgcacatttatccaaaaagcagttagctgatcgtgttgcctctgaaaaagcactgttcacttacaaagaattgcaagtacagccccctacatggcttgatgactatgctgtgaccgagtggcaccgtattgtaccattgctaaaaaaagacattccagttagtgaactagatgctgccctgattgccagtcattgccaagcctattctgacattcagaaagctgccgagctggttcaagaacaaggtatgatggttgaaaccaccgatagtgtgaaagctaacccagcagttaaaatgaagctggatgccacaaatcaaatgatgcgcattgacgaagtattgggactgtcagtgtatagccgggcgaaacttgccttaaagagtgagactaagaagaagcctgacgatccgtttgcggagctggtgtcatcgtgaactatgcgactgaatataccgacaaggtgctaagcggtgagattgttgccggtaaaaagattaagcaagcagcaagacgttatcgcagagacttgaaagccagcaagcgcaaaaagaatccgtggccgtattactttgatgaggactttgccaacaaagccattgagtttatagaactgatgccggcacgtgatgggtcaccactcaagctagaacttttccaaaaatatttgatctcagagcttttcgggtggagagacaaagaaaccggaaatcgtcgttatgatcgagcttacatcagcatggcacgcaagaatggtaagagcttcctgatggctgatctaggcgcgctgtatctcctcatggaaaacaaaccagccatgaatcgcgaaattgtctacacagccaacagtaacgcccaagcgcacttagcctttgatatgctgtctagtggtttgcgtcaggtctctaagatgtctaaatcggtgcgtgatcgtttgaagatcaaccgtaacgaaatcatcgacttgccgagcaacagccgagctgttccgcttgcgtctgatctgcacagcctagatggttatcaaagtgacttggctattattgatgagttcgccttagctcgtactgatgagattctacgaacactaaaatcaggccagatcaacagcgacaacagtttgctagccgtcatctcgaccacggggccagacctgaatggccctatgtataaagaatataaattcgtctccaaaatcttaaccggtcgcgaacaagcagatcggtattttattgccatttttgagcaagacagcaaggctgaagcctttgcaccagagacttgggagaagtcaaatccactactggctaatgctgaaagagcaaagacaatgcggcctagcttgcaagctgatgttgatctagcagccaagcaaggaaccctgcggccaattctcgtcaagaacttcaacatgtggcaatcagccagagcagacagttatatcagtcttgacgactgggagaaagccactatcgagccaccagacactagagaaaaggacgtgtatatcgggcttgatctctctaagtctagcgacctgaccagtatctcgtggttagttccagaagatggctacctgtatgctgacagccattcattcgtggggacgaagtatggactggaagaaaagatcaagcgtgatgggttcgattacatcagtggtgctagtcgtggcgaatgtagcattaccaaactggaaagcggcatgatcgactatgacgaagtgctacgcttcattctcgacctgatcgagcgtaaccagtggaacgtgcgtgccatctgttatgatcccttcgccatgggctacctgattccagaatttgaaaaacgcgatttgccactgcttgaggtgcgacaaggtgttagaacactttcaattccgacaactcgttttcgtgatgatctcttcaatggccagttaaagcaccctgataatcagttactggcctatgcggtcaacaacgctattctgaaatatgacgctaataacaatccaattatcgataaggcccacaacgctacgaagattgatcccgtagccgcactgatgaacgcttacacaattgcaatggatcaaaacaaggaaagcgaggtagcagacaatgacttttattcgagcgatgactttggtttttaatttgcagaccgtgctgttaatactgggactgatctgtatggttgccggtatctggtggctgttcgggtttggtgttggtatgttagcagtcggcacggccctgatctccgtcgcagtcattatcaacttcaataaagggaggtgaaacaatgagctttttcacgaatagcgcgacacaaccacgcgatgacaacagcgacccgttcttagatgcgcttgtcagcatgaccagcaacgacagcggcctatatgtggggattggtgctttacgtaattcggatgtatttacggccgtgcgcgtgattgccggtgatcttgcaaccaatccgattgaatacagtgacaagcgtatcagcgtgcttcttaacaaggcacccaatgaccacatgaccgcgtgggggttcaagtttgccctagctactaacatgctgctgaatggtaacagctttgcacgggttaccaagaatcccagcggacaagttactggcttcgagttggtccctaacagccaaatggtggttaaacaagacgatacgaccggaattatcagctacgaatacacgcctgacagtggccgctcacagcgtttaaatgccagcgaggtcttacacttcaagtgcttcacacaagacggttacaaaggactatcgccactttatagccttcatgatgaggtcggggtacaaaagtctgggcatgcgttgctgaaaggtttctttaactcaggtgtccaagggacaggcattcttaaggtcaacaagacacagttagacaccaaggccaaagaaaacatccgcaataaatttgaagctgccaacagtggtgataatgccctcaagaccatcattctcgacaatgatatggattacaagcaactcgaagttaatactgacgtgctgaatctagtcaattctagcgactggacaacgaaacagattgctaaagcgttcgggttgccactggatcggctgggtatcgaaagcgagcactctaatgccgtacagtctaacgtgatgtacttgcaaaacacgctgattcagtattttacctgcttcacaagtgagatggatgccaaactgtccacaggtgacaaccggttcagcttcaacactgacaagctgttttcagcggacccagccacgatgcaagaactagcagttaaggggctgcaaggcggtgttctaaccactaatgaagcacgagccaagttaaacctgccaccaattcccggcggagatgaaattatggccagtctgaactacacgccactaagcaacctgacaagctatcaaaacacaagacaaaggagtgatccagaaaatgaatcaagatgacgtagaaaaacgtctgaatcctaacgctggtctaactgccaaagcagacgacagccaaggccaagacgatccagacacaaagaaacaggacgacaccactaacggtccaaagaaactaagtggttatgcagtagttttcaatagcccaagtaaagacctcggtggctttaaagaagtcgttgatccgcacgcattcgaccacgtggacttatcagacgtctatatggtttcaaaccatgattttagccaagtcttagccagcaccaaggccggaaccttgaccttaaacgtggatgataaaggcttgcagtttgaagcaaccttacccgatacgaccacagccagtgatgcttataacaacgtccaagctggtaatctatcagccatgagttttactttcaatgctgcgccagacggtgacacgttcactaaagacgacagcggacaagtcattcgtaccatcaagcaagtaaagagcttgtttgacgtctcactggtagctattccagcgtatgacgataccaacgtccaagtggacaaacgcagctacactgaatggttgaaagaccatgtagaagatccagaacagcaactaccaccaaccgaaaaacgaaagggagtcaatcacatgaccgaaaaaactattattgataaagaagaacataccgaatctcgcgcttacgaagactacatccgcagcatgggtgaacaacgtgacggcttgaccacgaccaccgctggtgcagtcgttcctaaagaagttatcaatgacgtttgggacttaaagcaatcagattatgacttggctaaatacgtcactgtgaagcaggtcggtaccccagtcggcacctatccgattgccctcactaacaatggcgtcttagccaccaagaaagaacttgcagacgtggccgatgttgacgccaatatgtttaaaggcgttgactacaaagttgctacccgtgctggcaagatttatctgtctaatgaactggtagaagatagtgaagttgatattgttgccgaggttaagaatcaactcaagaagctggtacaaaacacggacaacagtaacattatcagtgttctgactggcaagtccactaccggtgataacttcaagcacctcactggtactggtctcgatgacctcaagaaaaccttcaatattgagttggacccagcactgtccttgtctgttatcgtcaatcaggacgctttcaactaccttgataccttgaaagacagccaaggccgctacttgttacaaccgtccatcacggcaccatcaggcaagcaactgtttggggcaccggtgatcgtggttgctaacaaagtattgccgactgataaggtaggcacctatcgaatcatcatcggggacttttctcaggcaattttcttagcccagaagaacgaagttaacacccagtgggaacgcttcgatagctattctcaaggcttggctgttgtcatccgcaacgactatgaagtggttgatccagatgctgctcgaattgttgacatcacaccggtaaaggcctaagagcataatttagtggggtgtgccttagggtacgcccctatttttataaggagatgagcacatgagtgttaccacagaagatttaaagaaagcactgcgcattagtcacagcgaagatgatgctatgttgtcagcctacttgttgacggcaaagcagttcgtgattagcgcggttgaccagacccttacggatgaaaactttggagatgatcctcgttttgactttgctgtctcgttgttagcacaacactggtatattaaccgtggtgtcgatggggcaacgtatgtaccagatagcgttgtgagcatgattcagcaattgcgaggtgttgactatgccactggtaaatagcatcagccaactgaatgaacccattactttagtgagctacacgatgggtaatgtaaatggggttcctgtgagcaacgtcaggaaagagcacttcacgacatgggcacttgtgttaagccaatatttaagcgaagtgagggcgtcagttgggacgaagctcgaagatacggtgacctttgttgttcggtatgatcagccagaaaccatccttaactcatggcgcattgaatggcaaggaaagaagtacgacattgtgaaactgacaccggacacagccaaaaaacaatggacaacaatcataggaaaaccagttgccaataaataagtattaacttataattaggatagtcctaggcgataagcgggcagaaccgttttaaccgacgcacggcatagctaaccggtggcgcattttatagaccaagtcagattgatttctcgtagcaagtgaagagcattcctcaaccctcgctgatacgatagtcatagtcttccttgacttgtttcattgtttttcatctaaagtagcaatatcattgggcaaagcgggcagagatgcccgtttttttgtgtgctgagagacgcattctgatgcaagctgaacaagtttaacttgaggtatggtcgttctggacaataaaaatcggttaggcaatccggaatttcgggattggctcaacaaagtccgaaattctgacgttcaagaacgaaccagcaaattgtgggttcgttgggaaaaggcaagtcaaaaatattgacctgcttatgagaaccaagtgacaaatattcacctagtcaatggatacaaaaatagccacctcatagcgaagtggctattttgtgttagtcatgtagcttttcttgtagtttatctccagcattatcaatgcccttagctgcgaagactgtacctgcaactaaaacaccgccaacgatgagagtactagcaaccataaacttaaatgcagcttttaaagcgtccataaagatggcctcctatcagtcttttgatctgccaacaaagaaggagactacggcaacaacaataattgcgccgataattgaaggaatcaaagccattcctgccagttgtggcccccaatggcctaaaagtccctcaccaattgcagaacccactaatcctgcaatgatgttagcaaaccagcccatcgatttgcccttgctagtgatagcaccagcaattgcaccaataatagcaccaacaattaaagcccaaagaaaatgcatgataattcctcctttttggttatattgtctctatagacgaacacagtataacatacagtagcaacaagagataataaaatagccgcccataatggacggccaccgcctgccaagcagaaatgaactccgtggttttctcgtggttttcttttattgataatcaatgataaccaatgacaatctggttaaaataaaaaccagtaacgacgctgttttgacaacgtttgctactggttgataacgctattctgggtggtcaggggatcgaaccctggacccacggattaagagtccgttgctctgccagctgagctaaccacccatttatttatgtctgtcgcgcttcacgacttaaatataatatcatgtaccccttactggcgcaagtgttttgcgaacttttttgcgaaaaatcgttcaatttggtattttgacgccttcgacagacttctccatggcgtattgccgacttgctttgagccatgctgacatgcaaaaagacggccgcggccgccttttaaaaattgttagaataaaacgtgaatggactgattgctgttgatcaacttgatggccttgcctagcatcgggccaacagaaatttgatcgagtccttcgaattgatgcttgggatcgagttgaatcgtgtcagtaatgacgaccttcttcaatcctagatgtttgatccgatcaacggccccgcgtgaaaagacgccgtgagtagcagctgcataaacatctagtgcaccagctgcacttaaggctttgtaggagtcaacgattcgatcacctgtatcaatcaggtcatcaatcacaatggcgtgcatcccttcaacgttaccgatcacgccgatgtgttcctgatcacgtttgtcgacaatcgcaattggcgtatgtagttcttctgccaatgcccgcgcctgtttggttccgctatgatcaggggcgatgacgaccacattatcgccaagattcagctttctgaagtagtcgccgattaaccggtgggctttcagatggtcaactggaatgtcaaagaatccctgaatctggtcggcatgcagttcaaccgccacaatccgatcgactccatccatttccaacatattggcgaccagttttgcagtaatcggttcgcgtgatcgtgctttgcggtcagcacgcgcatagccatagtatgaaatgaccacgttaatatggtgtgcacttgcgcggcgcaatgcatccaccatgatcatgagctccatgaagttttcattcactggatcagagaccgattggatgacataaacatcagcaccacgaacactttccggcagctcgatttgaacttctccatcggcaaaatgattcactcgagcgggcgataacggtaaacccacttcggccgcaatcttttccgcgagtggtcgattgccattgagactgaataattttaattcgtgcatcgatttctccctttttcacatttaacggtttgcaatgttattatacgagataaatcgagaaattgcgactggttatgcaatgagttaaagtaataacagaatatttgcagattcataagcaaggcttcggcaagcgtccgctttagcatttgccatgctttgatccaactgcaagactaggaaatgggaggctctttatcatgaaacaaagccatttgatcggccttgcaaccccactgttgttgtcagcgggcactttagcaactgctgagcgtttttaccaatatgcatttcggcgaatcaactacattcctgatgcccgtagctccatgcaaaaatacgcctcatcatattaccgtcatgtccactgggttgaaagtcagcggcatattgaagcctggcatatgacagctccggataatcagcggcttgaagcactttggctgccgcatcccggtagtcaaaaagcggtgattatcggtcatggttataagggcaccgggattaccatgagtaactttgcccacatgttttacgacttgggcttcaatgtgttgttgcctgacgatcgtggccatggtgaatccgatggcgagtacatcagttttggctggttggatcggcttgattaccttggctggctgcaacgcattcttgaccggcttggtaacgatgcccagttattgctgtttggcacgagcatgggtggcgccacggtttcactggtcgcaggcgagccgagtttgccaaaacaggtcaaggccgtaattgaagattgcgggtacacggatgttgaaacggaactggcttatcttttaaagaagcaattccaccttccaccgctgccactggtaccactagccagcttcatcaattatcggcgcttaggttatcctctccgcgtggtcaacgtccgtcaggctttaacgcgaaaccgcttgccattactagtcatccatggcgctgaagatgtttatgtgccaaccaaaatgggccgcgaaaattacgctgcctccgctggtcccaaagcgctctggattgtcccgggtgcggcccacgccgaaagttactggattaaccccgcggcctatcaagcgcacgtgaagcggtttttggatattttcttttagcgcttgcactcctaataatagtcgtcatgtggcagctacgtttcgttgccatttcctccgcgtagccttcaaactgcgcggtttttttaatctaaaaagactcagatcgcctctgagtctttttctatcgccggatgagtggctgctatgactgccacttccgcagactattcaaattcgttttcttcagcttgatcttgctgcttgcttaacgcatcaaacgtccgcagcatctccaagttcgtctcaatactttccggccattcccaatgttgaacattaaacacatgcttgaggtgtggccccgcacttgccggccatagctttgttgtataggtgacgtgattagcatcgaacaccttcaacaaggcttggctttgcaagtaaaagctgtcattttgcccgccaatcagcataaacggcggcaggtccaagcctttgacaacctgcgagaaattcaggtgatcggccagtgcctgatcgccgccgcttaacttgtccagataaaacgcggccatatcgctcatgtcaccggctgcttctggaagcttacttggttcggcgactggacaaaccagcgccaccagggtgaagttgaaattaacccgactcacaccaaagagttcctgtaactccgcactctgctggatgcaggcaaccaaggacgccaggtggccgccagccgaatctccggtcaaaagcacatggtcaaggtcaaatccgcgttgagggccaaaatgcgataaccagcgcagactagcaaagatgtcttgaatctggccgcgtaaatcaacatccggtaacaaccgatagcccatacccatcactgcgtatccttgactagccaaatagcggcaataattacgattcaaattacgatcaccataaaaccacccgccaccatgaatatcgatgacggtcggcatggttgcgttgcgtcttttggccggatagtacaggttcagggtttgctgcggatcagccgactgttcgtatcgatattccgtctcccaatgaacatcttccggtacccgttcatccgcgtaccgtgccttatcccgagcagccgtttgcgcccagctcgcttgaacctttgccaacattgcctcttcatctgccattaacgaatgcctccatttcctcgtgttaacgaatcgtgttaaaaggttattcctatattaacgcaaaaagactgccggtgcgtcacccgacagtctaatcgtttgattttaagcccgttttttaacgatccttggatttaacacttgcttcaacttcatcaatcaaagcagcatcttttaacccggttacttctttaatgacgtctactaatggctgatctttgagcatcgcctgaagtttaacggcttcggcatcattaggttcaacataatggaacatcatgccaaccgtatccatcaagacgctgtaatccaagccgcgttccttcagttcccgaatcggccggatgaagcgttcgttgtagccaagcttacgaattggcgtccgggcaactcgcgaaatatcatcggaaatatatgggttctggaaccgttgcaagacccgattttgataagtttcgagttccttttcgtcaaagttcttgaattcagctaaaagcagcgagcgggtttcggcaagtgcacctttggcctgattgaagactttaggatccttgatggcttcaccgatcgtggtgtagcccaagtacttgccggtgtaagccgtggttgcgtggccagtgttgactgagaagagcttacgttcaatgtatggttcgagatcaggtacatagtcgacggtcttaagcttcagatcatggttcttcatctggctttcgtcaacaacccattctttgaagtcttcaacactaacggctaatggatcatcatgtttttgctgcgggacaatgcgatcaaccgctgcattagggaagccaacgtacgtatcagcaaaggtcttgccggcgtcatcaagatgttcataaacgctcttcttcagcgactgtgatccgccaatcatgttctcacacgcaatcacatctaatggttggtggttgttagcggccgcgcgtgcttgcaaaccttgagcaatcagcggcgcaatgatcgggagaatcttcgggccaatcgccgtcgtaaccaagtcggcttgggcaatagctttcacaactgcctcaggatccttagcgttattcaacccgtcaacattgtccacatgaattttcttttcacccggggcggccaaagtgatggtgtattccccgcgctgatttaacgcattgataatcgtctcgttaacatcgacaaaattgattttgaatccattagcggcaagcgtttcaccgataaagccgcgaccaatattacctgcaccaaaatgtactgcttccatcatgatttattcaacttccttcagtaaattgacgatttcttccggcgtttgtgcgtcggccagtttttgaacattttcaacatcgctacaataaagcgcaatttgtgagagtagtttgagatgctcgccgtttaatccggcaatgccgaacacaacggtgacgagattctcatcagccggatcatccgaccaatcaaccccccacggatattgaacgaccgagataccggtctttttaatatatttcatgccgtcttcagtgccatggggaatcgcaataaagttacccatatacactgaaacgtcacgattacgatcaatcattgaatcaatataacccggttcaacgttgccattgtcgaccaagagttggccggcctgacgaatggcttcttccctggtcttcgcttcttgaccaagtttgatcgtctttacgtcaagtcctttcatcatgtcaccttcgatcaattttttgaatttcgtgcataaagacttctgtcatcacttgatataactgactatagtggcctttttcaaaaagctgtatgtccgctggtgaagcaactagcttggcgctaactgcactcaggagggtcaatgtttcttgtggaacaggattcggcgtcagcaacaggagaatccgctgcagttggatcgtgcccatgtccattgccgctaaaggtatcgctgttttgagatcaaacgccccgatatatggggttgtgacaccgcgactactcgtgtgaatcattgctaaacctgtattcgggatgccaaccggcgctaattccaatctttttaacagtgcttctttgacaattggcggttcaacgacaacggtcggtaaccgagcaagcatcgcatcgatagcagcagcaatcgtggtgaccggctcattcaagtcgttgacggcaaagtgttgtaatagcccatctgctgccatcaccatggtttttaggctctcaaaggcggtaactgtttggtccagtgacggttgattcaacggccgcacttgtttaggtgtggcgcgttgaacaagccggcgcacttccgctatttcctcgcgtcccaatatcggcgtaatcaccaagtactgatgcttaaaccccggcagcggcatggtagcaagtaccagatcgtaatgttcaagttgttgttccggtaaatcactcacctgaacaatcttaatcttacgaatttccggcacctgcacgcgtaactttccagcaatcaggctgccggttccgggtccatcactggtaaccaatagcacggcaacgggtttttctgccggagcgtgatccaaaaccgaagcgaagtataaaaccagataggcaagcgcatcgcctgtgaaggctccttggccgaaaacatgatcagccgccttttgaaccgcttggtaaagttcaggataatcatcttgcaaatgagcaagtacgggattggtcattgtgacaccagacagccaatcccctccggccgttcgttggacatgagccagtaatgaagaataaagctgtgggttcccggaaaatttcccgggaaatgatcgggctacttcccgaataagatcctgaacttcaaggttgatggttaaatcaaattgatcaaccggttcgcctgccaacccgccgcgaatattactcagttcgatggcaaggaattgataatcaccgacacgtactttttcccggattgtcgaatccatctcggctaggaattgtagcgccagttgttggtcctgaaacagtcgttcctgatcaaaatgctgttgcggtttaacgtgatggccctcacgcaatcttcgtgtattaattgcaactgttagtagtactgctttacgttgattatcatttagatctgctaaagctttaatctgagacagtgcggtgttagctgcaagtatttcttcttgcggtaaccgttcaatgaaatagttcgtcaccggatcaaagtcttgctgcggatcgtttaggaagcgaaagaacacatacggattaatttcagcattcaagacgccgaccagaacccggcgaatatcaccttcttgtccttcaatccagataccagctgctttttgccgattcagcttgagatgatattcatttaacgccggttcgagaatatccagatcttgcttaatcgtcgtaatgctgacatctaccgcatcagctaaagttgtcatcgtcaaagtttcatccgttgtcagcaacatcagtgttagcgcactctgcctctgactgggatcaaaggtgagatcttgccgttgatgtgacaaggctgcagatagactggctaaatcagcggctgcccccacaatccggtatgagctgccattgcctttgtccaactttaaattcaccgttgcgatatcatgctccagttgcgaaagctcacggtaaatggtccggcggctgacgcccagctgtcgctccagctcgtcgcggcttatgccggcgggctgactcatcatcagtctgatcatttcctgttcacgattcgttagtaacatgtttttcgccccagacggccgcaactcgacctcgcttatttcaatttctcaataagtttatcatagttcgtcgcgttcaaaagaccatccacggtatagacttgaacattggcaaattgtaatttaacacgccgggcagtttctttcgatgcgatgattaagacatgatccttatcatcaatctcaccgatcgcaacattacgaaccttgacgtctttgttgagttttcgcaactcagagcggaatgtcgcttgcgccatagttgccgagccgatattttgatcgtgatgcaggaagtctacttctgtaatcttatcgaagtcgatatcgttaagctcgtcttctggcgtttcctgcttagcttttggcgtttctttagttgcggtttcatctgtcccgccaactgcttcagccttcaaactagcaatgatctcatcatacttaggactattcaagaagttctcaacagcgacgtgtgctgcatcaggtgtttgtttcttagcccgatcagccaattcttcttgcgtcacaactaagagtcccggcttatcctgcaagttgctaatggccgtgttggtaaccgacagatccaaaccagccttcttgactttatcacgaagaatcgaagcacccatggcactggagcccatgccggcatcgcaagcaaagataatttgcttaatgcctttagcctggctcatgacatctttagcagcagccacatcctgacctttagcttcagctttcatcgacttcatcttcgcttcactggctgccaactcatcgccagtacccttatcgcggcgcaagatgaatgccgaaatcaggaaggaaacggcagtggcaccagtaaccccaacgattaagccgatatagtttccgatatcaaccggtgacatcgcgagcaacgataggatggagccgggagatggcgaactctttaagccaacattgaagattgagaacaaggtcgtcccagtcacaccaccagccataactgacaggaacaatgccggtttcattagaacatatgggaagtaaatttcgtgaatcccccctaagaaatgaatgatgatggctgaaggtgcagaacctttggccgcacccttaccgaataaggcaaatgcaagcaggacaccaagccccggacccggatcaggttcaagcaggaacaggatggacttaccatgttcggctgctgcctgaatcccaagcggtgttaagatcccttgattgatcgcattatttagaaacaggatcttagctggttcaataaaaatatttgctaaccataacagaccatgattgataatccaatcaacgccggctgccattgcgttagtcaagccggaaatgatcggtcccattaagaagaagccaacaattgctaatagcatcccgataatgccggcactgaagttattgaccagcatttcaaaaccttggcgaatcttgtcttggacccgatcgtcccatttcttaatacaccagccgcctagtgggcccatcaccattgccccaatgaacattgggacattggttccgacaataacccccattgcagcaatggcgccaacaacgccgccacggtgacctgctaccattgaaccgccggaaaaagcgatgagcaatggtaataggtaagtgaccattggcgtgatcatttttgccagttgcgcatttggcagccagccacctttaaggaagatggcagtaatgaggccccaagcaataaaggcgccgatgttaggtaacaccatgccggaaagcttggtcccgaatgattgcatgccggccttcagattgaatttcttcttctctgttgccggcgtgtttgctgatttagcttccaaagcaaacactctcctttcgcttgtttacgaagattattgtaaccgctttatgtaatcgctgacaaaagctactttggcacagttagttgtgccaaatattcagcatcaatcccatcagcactatttgtgggtcaaaataatacgtatcagatagtaacagtattcgttatctgtttcacaagttatctaaacctcgacgctgttggtcgcctgcaattaagccatgtggattgctttttgaaaaagaaaaatcagtttctaccatataaataaggaacatctcagtgctatttcagctgccagcgttaatcataaagccacgctccttcgtgattcggtttacaatgtgacggcgatttagtcacagcgccggatttttaaaagaattcaaattaggtatagaccattgttgacaccgccattttatggtgttatattggactagaccagataagggggatatcaatcatggatgttaaagtttttgataatgatacagaagcaggaaaatacgcatttgacttgattaagcaaggcatggacaacggtgccaaggtgcttggtttggctactggcagcacaccggtcaccatgtatcaggcaatggtaaacagtgacgttgatttcagtaacatgacctcggttaacttggatgaatacgtgggtatgtcaccagacaatgaccaaagttaccattacttcatgaagagccatctttttgacaagaaaccgtttaaggaaaccttcgtgccaaatggtcttgccaaggatccagaagaagaaaccaagcgttataacaaagtgattgccgatcacccaattgacattcaagtcttgggtattggccgcaatggtcacattggcttcaacgaaccaggctcaccatttgatgccgaaacccggaaagtacctttaacccaaagcaccattgacgccaacgcccgcttctttgaaaacgaaaacgacgtaccgcgctatgcttactccatgggtattggctccatcatgaagagcaaaaagatcttgcttttggcatttggcgaaaataaggccgatgcggttcaaaagatgattgaaggccctgttaccaacgatgtgccagcatctattttgcaaaagcatccggatgttgtcgttatcttggacaaggctgccgcaagtaagttaagccacaaataatcagccattcagcaccatttaatggcgtgagcggccacattagtttgcgcaggtaaacattaaaaactcgaccctggaaaattttatctggggtcgaattttgtttctgcttcattaataggaagttgctgattctcagcgtcctaaatcaccgcgctgaatcgtctgtctgcgcggcttttgtgtaagcggtttgtttgtttacccgccacggctcacacctaggcagatccatggtagaatgaggccatcatcttaatttatatatggaggaaactatgtacaaagctgttgtcttttttgatttagacaaaaccctgctgaatgatgaaaaacaggtcccgccggaaaatgttgctgcactaaaagcgctcgaagccaaccatgtcttgcctgtcattgctactggccgcaactactacgaactcgatgacatcatggccgttaccggtgttcgaagcgccattgcagcaaatggtggtgatattttcctggaaggcgagcatattttccaaagcgtgatcggtgagccgcaactgacacggtttcttaatgctagtgctgcccgcaatattcaggtcgcgatgtatacaagtgaccagtcagccttaacgggacacaacgagttgaccactgataattacgctcaggtgcggcaaaccccgccgccgattaagcccgatttttacaaacatgaagccgtctgcatgctactaatgtttgtaccttggaccgatgccggcgatcaagtcgggcaacaattcattcaggattttccggaaatgaccttctaccgtaactcacattacacctttgatgtcgttaatcgcggcatttctaaaggtaccggcatgaacatcttgctaaatcaacccgcattgcgcgatattcctacctacgcattcggtgacgggtataacgacattccccttttgcaggcagccgataccgggatcgcgatgggcaatgcttatcctaaagttgctgccgctgctgactatcaaaccgatgactaccgtagtcatggcattcccaatgcactcgcgcatttcaacttgatttaattcggttttaacctcatcggccacatgcggtgaggttttttggttcttctcagccatcatttaaccaaatttcaggttgaccattcgaacaaatgttcccataataaaaactggtattcagtcgtgaaaatatttttatttttgacggcagatcattgatatatcagcatttctgcaacttcctataacgtgttcacggggtaaagtcaagaccgcaactgcgcgatttttctgctatactcaaagcatgttgcacgttatttgggcgtggtcgtatcaccgatcagtaacgctgcaacatcgataaatctgctgatggaggggtctcgttatgttagaacaatcgacaatgcatcctgtggtttggatcaatcaacatacttatatcagtatcgttaagaatgcggactacaatttagaagtttgggagattaccgccgaaaatcggcagcatcggatggcccggatgaactacaaatatcatcgcgataatttcgccgggtttatctatcggctctttccgcagatcgatctcattcaaattcacaatattcaaaagaagcttaatccctattttgatttagaagtttagaggtgttcacatggatagtctggttttgcaactgttaatcatggtcgtagtcgccttggtcatgacgttaacgattattattgcggaatggcgcactaagacgttcaaaacatggcagattagcgttcaatccgtggttgcggtgttgttattcgccatcggtatcagtttgctgacggttcgctgatttagaaaacctgattgcgatgctgccagatatggcattacgatctgcttggtatctatcaaatatcacaacgcccagtgatattttgacaacttagccgacctaccgactgccactgaaaagcacgcctaagaaagaaaccagcattaataagctatgtacatcctgctaagctaatcggctttcgagaagacgtatcttgtcactcgaaggtcgattttcatattcatgccctatttaggtgcttactttaaaaaatagtcgttatttgcggtaacatttaaacttctatgataaaattaagaaaaaatcacaggggcgtttgtatgcatcacttggaaatccctgcttcgcttgcacaacagttggttgacggtttaatgggcggctataaggattaccttgctgagcgtaagcagaaacagcagtctttgactattagcggtgcgtttgcctggacccggagcaatttcatcgactctaagattagcgaactagtcagtaaggaaccttcaattagtagtcaacctgataaggccggatacgcttgggaatacattcaatttatccacgaacaaagcaatcatcgctcattgatcattgttaaaaatgcgcggcagctaaagcgtcgattcaataatacgacgactgtagacaaaaataattatctttatcagttagccggcatcaataatgagttgagtgcagccggcttactaagcagtcggcaaactaatggcgtcattcagctggaactagctttgcctggtaccaacaatgctgttgtaagtctcatgaatcaaacagctcaaaaatcatcaccgttctcaaagttctacattgtgacttacgcggtagataacgacagcaagatgattaagcatattgaactaacgatgccgaatcaaaccgaaatgactttgaaacccattcaagacttaacccctttaatcaaacaaagtccattccagatcagccttgaggaagttgagccgattcagtctgatcaggtgccagatgcagcatatgaacaaaataccctgtttggctacgaaattaatgctgatcctgaaacagaaatggaggcggacgctgaatagcggcaattaatatgtttattggttcaaaactccaggccctacgagaattaaacggctatacacgtaaagaattaagtgatgtcattggcgtcacccagcaagctgtctggcaatacgaaaacgacaatgtcatgccgaaaatagaaattctaaacacatttcaaaaaatttttaacgtcgaaatgctctttttaataagcgggagcgccccgaaacacgttgtccatgaagaaaaaatagccttcagaacatctgaccattcaagtcgcaaaaagactaaattagaagcacgctacttagactttgccgatgacctgacaagttattttgaacagttcgtccgcaccagccccaccggatttgatcagcttcaaaaactggtccatcagttggtactaaatcagcatgagccttcaccgattcgcaaagtggcaaaagtagcacgaaattttttaaaacttcaggataatcatgacttaatggccaagcttgaacaaataggcatttatattgttgaaaaagatctcggtagtgatattgatgcctattcaacgattgctgacagcggccgtgcctggattgtattgggttccatcaagaaatcagcagttcggcgtaattttgatcttgcccacgaattaggtcatttactgctccacacgacgcttgatttcgatgaattaaccacctccaaatataagcaaattgagcacgaagcccacacatttgccgctgaattacttctgccacttgaagactttacacatgatttcaaggcgctgtatcgccgttcaaatcctgattattaccttgacttaaaacgtaaatatcaggtttcaattgttgcgatggccatgcacgcctatgatcttgggctgatgagttatcaagaacaacgctatttctttgggcaacgcaacaaaaaaggataccggttaatggaacctctagatgatcagttgatcccagtacgccccggaaaattgcgtgctttgatcacactgttgtttaatcagcacatactaacgctcaatgatttttatcaaagactacatgtccgacctacatttgtcacccgcctttttgctctggatagtaacttttttgagaaatatcagccacagcatcagtatgtgaatcaccataatgttattgcgttcccgcagtctttcaatagaaattcaagcatttaatctgccatgtttgggttactgtcatcatccctaaccaattgaaaacgagtgagtctctggagaataaaaaacggagattcactcgtttttggtttcacgtggaactttttcaaaaaatcttaacatccggtttttggtcaaatctgttatttcaaccatcaacttgacgccaagactcaattggcatagtcgaactggtggcagtgtttgcccctgtatattcttatgattttataaacgtttttatcattacgagctagtttcttaatcaaccaaacatcatgaacttcacaaagtttatggttggacgttaaccaattcaatccgtatactgacaccaacagcacggtgacgaaatacgttttcacggaggcagcatgatgaaaaacagacagaacaagcataaaggcatctcacaacgactggtcattatcggaatcggcgttttggcagtcatcgttgttacgattatctttttcgtaactcagcagaagcaaacaaaaccgacaactgcgccagctaccctcacgacttatcaggtgaaacgccatgaattgcggttatccggccaggtacaagctgtccgttcgcaaaagatcgatattccagaaggcaccgtccaaaatctcaccgtcaaaaacggggacacagtcgcggaaggtcaacagttattgacggtctatcatcccgatgtccagcaaaagattaccactgccacgcaatcacttgcaaaacagcaacgcagccaaaagcaattggatgaccaaattaaccaactgaaaacatcgctgaatcaactggctgcagacgatccacaaaaatccgagattcagtcacaactcacggaagcccaaaacagtcgccaggatgcggctgcaagtgttgatcaagccacacaggagctgaatcaattgcaacaggatctaaacaccgtcgttaaagcgccttttgccggccgcttatatatcgactatcaatcaaatggcagtcaaagcatcacggaaacctcttcagacatggaggcagtcggcgaagtgtccgaatttgattacaatgatgtcaaagtgggacaaagcgctaccgtccaggcactttcaacgaagacgaaacaaacaacggcgattgattttattagtagtgatcccgccaaatccagtaagccaaatctggctaaatatgaagtgacggctaaactggatcaaggcttcctcaacggtcagtccgtcagcatcatcttgccattaggcggcctcgagatccctaaaaccgctgtccgccaaggttctgtctataaagtcgtcaatggtcgtgctgtccggactaagatcacttataccaaaaaagacaacatgtatgaagtgactgaaggtctcgacagcggcgatcgcatcctccaaagtccgaccaaatcaatcaaaaacggagcgaaggtgactgtcgatgattgaccttcaaaatgtcaataagagctacggccaaggtgataccgcttttcacgttctcaaggacattaatctgcacatcgaccaaggcgagtttgtcgcgatcatggggccttccggatccggaaagacgacactgatcaacatcattggatttcttgatacggcatttgagggcaaatatctttttgaagacgaaaatgtcgccaacttcaatgccacaaccgcttcacatatgcgcaatcgtaatgtcggctttgttttccaaaacttcagtctgatccataatctgaatatatttgaaaatgtcctcattcctctaagttatggtggtaagcgccgatcagaggttaaaggacgaatcgccgagctgctcgattcggttggccttccgggagtcgaagataagctgccgcgcaatttatccggtggccagcagcaacgtgtggccattgcccgagcgctggcgaattcgccgcaatttctgattgccgatgaaccgaccggcgctttagacagccatacttcagaagatattatgcaacttttcaaaaaactgcaccgacaaggcggtacgatcattatggtcacccatgatgaacatgtggcgctggaaagtgaccgtatgatcaaggtcctggatggccagatcatcagtgacacggaggtggcccatgcgactaactgagctgattcgaatttcttttcgcgcattggcagctaacaagcggcgcagtttcctgaccatgctggggattatcatcggtattgcctcagtggtgaccatcctgtcgttaggtaacggcattaaagcggcgacggttaaaaacctgcaagcagatacgcagggacaacaaactgccgaaatcaccttcaatcccaacagcagcggtgacgccgatgcaggctttaaggaaagcgatgtcgcccttgccaagcaaaccgcaccggataaaatccaaaaagtcgtcatcaaacatgaaaaagaacgtctgcaagtcatggggcaattagcgaatgccgacactaccatgtcagtgactttagtgaataaaaccaaacctaacatttcgcttatcgccggatccggttttaatcaggattccttacaagcagacggtcaggacgccttgatttccaagaatctggccaaaaagattttccatggtaattctgccgctttacactcttcactaattctaggcactaaaagctacaatatcgctggcgttttcagcccacccaagtctaattattcggcattagacgtcgaagttctggttccggaaaaagcctatcgcgccggtcagctttcacaagaaggacgcaaacttgccatcacctacaaacgcggcagtgatgtcggccaactgaccaaaaatgtcgtgaagcagttaaagaaatccggcagtgaacatcgcagcggcagctatgaatacttcgattacggcgaactgcttaagggaatcggtaacgtcatcagcggcttaaccttgtttgtcagcgccattgccggaatttcccttttgattgccggtgtcggcgtcatgaacatgatgtacatctcggcctcagaacgttcgcaggaaatcgggatcagaatggcagtcggtgccacaccggccgaaattatgaaacagtttctgctagagtctgtgatgttaacactgactggtggcatcatcggtctacttgtcggagccatggatgcgtggctcatcgccatgttcctacccttcaaaccggttgtcacggttggctcgattgtcggaacctttgcaatttccagcatcgtcgggatcgtcttcggcttgctaccggcaaaaagtgcggctaacaagaatttgattgatattttgaaatcgtagtgtttgggtggccgctagaaacttacgaaacaaaatgaagactgcataacgaaaccgtcgcgcaaaagtcgcgacggtttttgctatcgtaacccagatagcccgcggcggataacgatgtgggttataatcagaacacgtccaacctaaaggagatatccatggcgctttatctttttctcagcttattaattatcgtgttactgattctgacattgctacagtatctcaacaccaaccgcatcgttgatcaacagctcacacagcacaaaatgatgtttcccaatcaaattcgcagggctcgcagtgtttacatgcgcggtatttttcgcgctaaccatcgacagcgcaacttacgcactactgccatcgtctcggatatcctcgctgccatctgcttagtcaacgccgtcgttgttcactttcaacctgattcaacggttagcttgggaaactcgttacttcgcggtcaagcgctccatgtttcttcacagctcaatacaaccattcaaaacacttctttgttgatcggcatgttactggcactggtgagtcgagtcgtttggttgtacctgtcacggtggcgttaccagaaactagttaaagcagacagcgaacacgccagcggccccactgaccttttctggacgcccgctgcgttacttcgaaatcagtatcatttacagctcggtattcaagctgtgctcatcgtcggtgccatctttcttgccttaaccggtctattcgactggcttccaacgccaaacaatgcaacatcacaaccacagtctcaatcggttcctacatcccccagctcaagtcgtacctcggccccatcagtaaacaccgagtcaaatacaagcaatgcaagctccggttcaacaccgcaaaccacgcagccaacctacccgattgatgacatgaaaaaggcaccacttgccccggctgccgcattggcaaacctgaccgatgccgaccgagctgccctacttttcacgatgtactggaccatgaacgggttacagacttatcaagtggctgaatatgccaacagcaccgatgaaacatacagctatcatctggtatctggcgccagtggacaattaatcgtcttttccgagacgattccgtctgtgaatcaatccgattatatgttctacgcctttattcagggtgaaaccgttaaactctacaacatgtatcagtccaagcaagctatcaccagtctcgccagccagtacaatcttactgtgacaggcacaagcattacgccaaacatgccggagattcaggatagtaacatcaatatgcggcaactcatcagtgctttcctaacagacccggcttttgccaaaatcaaatcagggttaacccaaggcgcagcggtaccactgtaagcttttgcgcctagtttttgccataacaaaagatcccaccacatgagcagaactcatcgtgataggatctttttaatcactacatttctaacaaaacgtttaacggtgcgctttccgtttccggccagctaatccgaataagccgctcatcgttgccagcaacaatcccatgaggcttagtgtttgtgactgggtatcgcctgtttgtggaagtcgatgtttcgttccattatgcgtggaaatctcggactgttgggtgccagtacctgtattcggcaagtgatgatccggcgtatccggcgttgttccggtcccgggatcaggacttggcaaggcaacaatctcaaaaatagcctgctgcgtgttaacatttttcaacagattatttggcaacgacgccttgattcgttgcaggccagatgtgctgagagctaccgcatagcttcccggattaacaggagcttgaccgtctacaaagatcagatcgccggcttgaagctgaatttcagttccgtcacccaaaactaaccgataatagtcgtcattcaaagcgcctggctggccatcgtaagttttcttttgaagaccactgagcgttgcagatataggcgctggtgtaatggtgatggtgccgctgaacgtttgatcagtaacctgataattaggaccaatcgctacggccaatttagccagcccgcttgctgtcaaatgatacgtgtacgtcccgacattgacgctgtcgttttcaactgcaatatctgtgttcgtcaaggcgatcttttgagacttttctggcagttggacagttatcgctaatccgcctgcttgacttgcacgagtgacaccgttgtattggaactgaccatgattaactgtggcattcaccgtcagcggcgtaatcgtaatggtgccggtcaatcccgccaattcatcttgatctaactcgtagttcttgccaacagccttctgtaacttggcgataccggtttggctcaaccgataacgatacgtacctgctgctgtgccgtcatttgtcacaaggatatcttcccgtgtcagttgtatcgttgctttggcctcggcttgcggcaggtaaagacttgcctgtaatcccgcggcagcacttgctttagtatgaccatcataaacaaaagatgtgtcattaactgtcaccgcaccggtaaccggtttgattgtaatcgtaccagtcaatcccgccaagactttggcatcaaattggtaattatcacctgatgcctgacgtaatttagcgatcccgttagcatccaatttgtattggtactgacctacgcccacaccatcatcggttacaagaatgtctgtggcgttcagatgtaccgaaacaaccttagtaccaagtttgatgttggcagttaagtcgtgtgcctgactcgccttagtttgtccatcataactaaatgaaacatcattcagatcagctaatgccgtagctggcgtgatcgtgaccgtgccgccaagtttggttaagtcctcctttttgaattgataattagttcctgttgcctggcgtagctttgtcataccagcagcacttaacttatagtcgtactggccagcattgaccccgtcattgacgacaacaatgtcagccgcggttagcgcaacggtttttccattttcgcctagtttgactgtggcttgaatgccccgagcttcactggccttggtcttgccgttatattcaaatgaaacgttattgctatctgctgtggcaacggctggggtaatcgtgatggttccagtgatcttggccaaatcgtctgcagttagttgatagttatttccggttgcggcttgcaacttagccttaccagcatcacttagctgatagctgtaatgaccagcgtttacatcatcgttggctacaacaatgtcagctgacgtcaggtcaaccgttttttcagtttcgcctagtttgactataacttgaatacccttagcttcactggccttggtcttgccgtcatattcgaatgaaacgtcattgctatctgctgtggtaacggctggcgtgatcgtgatggttcccgtgactttagccagatcgtctgcagttagctggtagttatttccagttgcggcttgtaacttagccttaccagcatcacttagctgatagctgtactgaccagcgtttacgtcatcgttggcaacaacaatgtcagctgacgtcaggtcaaccgttttttcagtttcgcctagtttgactgtaacttgaatacccttagcttcaccggccttggtcttgccgtcatattcgaatgaaacgtcattgctatcaactgtggtggtagctggcgtgatcgtgatggttcccgtgactttatctaaatcgtctgccgtgagctggtagttatttccggttgcggcttgtagcttagctttaccagcatcactcagctgatagctgtacttgcctgcatctacaccatcattcacaacaacaacatcagccgatgttagagcaacaacttgtccagactcacccagcataaccgtggcttgaataccttcagcttcactggccttggtcttgccattatattcaaatgaaacgtcattactatctgctgtggcaatggctggcgtgatcgtgatagttcccgtgacttcagccaagtcgtctgcggttagctgatggtcgctccctgcttccctctgtaacttagatttaccagcatcgctcagtcgataactgtacttgcctgcatctacgccatcctccgcaacaacaatgtcagccgcggtcaggtcaacagtcttttcagtcccgtcaatggtcaaaatcgcttgaatgcctttagcttcactggctttcgtttttccatcgtactcaaagtgagcatccttgcctgttgcgattgctccagcaggggtgattgtaatgcttcctgaaaccttatccaaaacttctgtcgttaactgataattacttcctgttgccgcctgtaatttagatttgccgctgtcgctcagactgtaagtgtatttgccaacgattactccgtcattggcaacgataatgtcagctgacgataggtcaaccgttttttcaatttcgcctaatttgattgtggcttgaatacccttggcttcactggccttggtcttaccatcgtattcaaatgaaacgtcattgctatccgctgtagtggtagctggcgtgattgtgattgttccagcaaccttagccaaaccgtctgcagtcaactgatagttatttccagttgcagcttgcagcttagccttaccagcatcacttagctgatagctgtactgaccggcgtttacgtcatcgttggcaacaacaatgtcagctgacgtcaggtcaaccgttttttcagtctcgcctagttttaccatggcttgaatacctttggcttcactggctttcgttttaccatcatattcgaacgaaaggtcattgctgtctgctgtgacagcggctggcgtgatcgtgatggttcccatgactttagctaaatcgtctgccgtgagttggtagttatttccggttgcggcttgtaacttagccttaccagcatcacttagttgatagctgtactgaccagcgtttacgtcatcgttggtaacgataatatcggccgcggtcaagtctacaactttaccagtgtccagcttgattgtagcttgaatacccttggcttcactggccttggtcttgccgtcatattcgaatgatacgtcactactatcaactgtggtaacggctggcgtgatcgtgatagttccagcaaccttggccaaatcgtctgcagtcaactgatagttatttccagttgcggcttgtaacttagccttaccagcatcacttagttgatagctgtactgaccagcgtttacgtcatcattggtaacgataatatcggccgcggtcaagtctacaactttaccagtgtcgagcttgattgtggcttgaatacctgcagcttcactggccttggtcttaccatcgtattcaaatgaaacgtcattgctatcaactgaggtggtagctggcgtaatcgtgatagctcccgtgactttagccagatcgtctgcagtcaactgatagttatttccagttgcggcttgcaatttagctttaccagcgtcactcagctcatagctgtacttgcctgcatctacaccatcattctcaacaacaatgtcagctgacgtcaggtcaatcgtttttccagtttcgcctagtttgactgtagcttgaatacctttagcctcactggccttggttttgccatcatattcaaaatccgtactattactattaactgtagccggtgctggcgtaatggtgatttttccggaattttgattgatggcagtttgatcaatcgtcacggtatcacctagtaacgcttgtaaacgagcgaaaccaacgctgtttaacaaataatggtacgtgccaacgttagctgaatctttttcaactaatgagaagtcttctgaggtcaggttcatttctttctgagtgccatcactcaatgtcaccgtgaccgccaaatctttagactgactggctgttgttttgccgtcataaacaaaaccgctatcgctcaaatgacctgtagccgttagaccgatgattaattgtgccgtacttgttccggtaaaatcataacccgcagcagactggccttcatcatttgttaatttggcgatccgtgcccacgcagcttctgataattccacactgtagacgccagttttaatcagagcatctgcggctaccggcttaccatcggcatcaaagaaattaagatcacttaattctaatttccccgcatcaaaaccgtcacccaaactcagtgcaaattgggagacatcgacggtaatcggacttcctgttgcggtgacggtctgagtaccagtcaaagcatatgaagccgctaaccgttgcttgtaattgattttagcagaaccgctttctgcaccataggtataggtgaccacataagtcgttggctggctattatccacatgaccggtgacaaccccatttttatccttagatgctaccacattgcctttttcatccgtcactgaccaagtcaactcactcaatggaacctcagtaccgtcgcttttaatcgcgttttcaaaattcagttccggcttccatacctggccagtaaataggctgatgtcatgggcacgaatcactggatcatcgagatgaacaatgtagtggcctgtgtaggtaacaccgtcttgccctttcaaagaccaatcgaaattaaatccctgcgtcttagctggcattttaaacgacttacttgccgtatcaaaagttaccgtagcgccattaactcctttgatgtttgaaacaacgatgttttggtgggtcactccggaaatggccacatcaaagaaatcacttagacttacgtgcgccgagtctgtataggcatcggcattctgctccaaagcatccggggttgtcggcttggctgtcgctgctttcagcacagtgatccggttattcgaaaaagcatcattgccaatggttggcgtgccctcaacaacaactttaggaatcaaattagccttaaatgccttggcgccaatactcgtaacactgcttggtatcgtttgcgcatttaaaataacattggcttcaaatgcttcctggccaatcgttttcagtccatttcctaacgttaaattactgatagagttgtaaacaaatgcatacttaccgatgtcggtcacgctgtcaggaacatcgagtgcgtcctggatctggttatagccaaaagcagtgtcaccgattgtctttaaccgatcatccagaaccagttttggaattttattcccgacaaaggccgcatttccgatcgttaatagcttaggtggtaacgtgatcgcattgttaatcgtattgtaggcaaacgcactatcaccaattgtttcgagcgccgtggcccgagtaaagtcaacattttccaacgggccaaattcagtaaaggccagattaccaattgattgcaatttgggtccaaacgctactttcacaagcttcccgccataaaacgcctgatcaccaatctgctccagcgaatcgggtaagttaatcgccgtagcagtggaaaatgcaaacgcctgaaatccgagagttgtcaattgactgttttctgcaactgcgatcgttttaactttcgaaccataaaaagccgagccgctgattgttttgacattagctggcaggttcaacactgctatttgaacgtccgtagtatcattttcagcgttactctctgtttttttggtattttgaataaactgaaaagcgccatctgtaatatctcgaacatcaggaccaagggttagttggtcagtataaagatgataaaatgcctcatgatcaagggtggctacattgactgttacgtgatccgccgtggcaaatccaaacgcggtcttatcgaaagtggtttgggcgccatcaatcgtgattgtcgccgcctgaatcccataaaaggcaatttcaccaatggcaggtgagccgctcaccgtgacatctccggttactttgtcataagcgaatgcggacttgccaatagtttttgcgccattaattgtaagattaccagtgaatacagcaccaccaaaggcaccttcatcaagcgtcgttagattgtccaacgtcaacgaatgcgcctttaaagtggcgaatgcattttttccgatcgtctttgcacgattaacggtgacatccccagcaatattggcagattcaaaagcagactcgccaatatcggcttgaccatcaatttttaaagatgaagctgtaagactaaagaatgcctgtgcctctatagtctgagcgtctgcaatcgttatatctttcacgttagcaaaataaaaggcgcgctctgaaatgttagccgtcttcttcagcgtgactgaccctgccttaattccggcaaatgcggctttgccgagactttctgcattttcaattgtaatgttgcccgtaaactgactgtatgcaaaagcattttcgccaatggacgtgacagtatcagccacgttaacattacccaaattattaagcgttgcaaaagcgccattgttaatcgccgtcactttaaaagtttggccattataggtaacagacgcgccaatgttaatatcggtgacattggcgttggcgcggccggtaaccgttgctgtaccgtttgccgtatcaagactgtaggtatagtcgccaatggtctgcgtattttcagcagctgttgcattggccggagcttgcgtgttgacctgagttgttgttgccgattgtgctgctaaggatgcttgtgacgatgcagatgaagccgccgatgatgctgcggccgaagttgtctgaacagctgcggatgcaagtgagcggtcttcttgggtcaccgtttgcggtttgactgctgctgaatctgtcgctagcgatttcgaatcggttgcatcactcgtgcttgctgctgaatcgccggttgacgctacagctgaactagcggtgcttgatgcagatgactgggttgcagaactagcagcattgacagccgcactacttgaagcagccgctgtattttgcgttgctgtaccggctggctgtgggttaccagtcgctgtttttgcagtcgtttctgctgtggcaccggactgactggtaacggctgtcgtttgtggggatttgctgtcagcgtgaacctcctgccccggttgaaaaaacgcgggcatcaataataatgccgtgcctgcaattagccagcgcttcttggccttgtacattcgaaaccgtacatgtacggttttttctgcttgttgaatggactgtacccgtttagaactatgtttcacgatcaagaatcccccttatgatctacaacatctgcaggctaagaatttcaaaaacccaacccgttaccactataggtcattataattaatcttattgaattttataacagaataattattttttccaacaataataatcggcttattcagggatttcgtcaataaagttatcattttcacaatcgttatcaaaagcctctcaagaatgcccctcatcattctaaatgcccagtaactaaaaaacgctacgcaattcattagttcgaatcgagtagcgtaccttttaaaataaccccaaccttccaatccgttccgccgcttcctgcaacctctgcggactcgtaagtaagccgattcggacgtagccttctccatggcgaccgaatccgttaccagccgcaaccgccacatccgcctgatcgagcaataactcggtgaacgtctgactggtatatccagctggtaccggcatccatgcgtaaaaagtccccggtgaacttttaccatgccaaccaatcgcggtggtggcagaaaaccagacatcgcgccgttgttgatacaagtcgaccagtgccgggactgacgtttgatcaccgagcagtgcttcaatccctgcttcctgaatcgccggaaaaaccgagacgaacagatgatcctgaatcagattaatcgcttcaatcatgtcagcattgccagcagcaaaggccaaccgccatcccgccatattgtatgtcttggacagcgtgtatagctcaatgccgacatctttggcaccaggctgctgcaggaagctcaccggacgctggccatcaaatccaagcgcaccgtaagcaaaatcactgacaatcccaatctgatgggccttggcaaaggcgatcgtctcgtcataaaattccggggtagccaccgcggttgtcggattattaggataattcagatacagcagtttagcagccgcggccacttccggtttaattttcgtataatcaggcaaccaattattttcggcggtcaacgtcattaaggctaatttcacgcgcgctaacgtcactcccgatagataatccgggtagcccgggtccggcaagagaattgtttccccgggattcatgagtgcaagcggtaattcgaccaagccgattttggaaccgcccaaaaccgctatctccttctccggatccaatgtcacgccatattcccgcgcatagaactcggccgctgcttgcttaaatgtcggcagtccgcgaaaaagcgaatatttatggttcccgggccgcgctactgcctgttgcgtcgcgtgaacaatattttcgggtgtcggctgatccggattgccttgacccaaattaatcacgtcatgaccagccgcaatccgttcattgacatgtttgactaaactggcaaaaaattgcttcggcagtgcctgaagcacctctgattctgaaaatgtcactggataagcccctttttaataaattagcatgaacgattgcccaacgatgcgacctttactgacggcttaataaagttccggccggcgatccgtgaaaaccgggatctgctggcgtgcggccccaatgcgatcaaggtcaattgtcacaatccccacctgtggctgatcgtctaacttcaacagccgttcaccaaaaggatcaaccacctggctttgtccgccaaatgcattgttcggatcgttaccgacacgattcaccgcgaccacatatgcctgattttcaatggcgcgtgctgctagcaaggcattaaattgcggcaatcttggtgttggccattctgccgggagaaagaacagctgggtcccatcgctggccatgcgccggaaccactcgggaaagcgcaagtcataacaaattgccacactggccggaacaccgagggtaaaatgatctgccgttgctccggctgtgataaacttttcttcattcattaagcgaaaccgatgcaccttatcgtacttggcaagctgccggccatgatgatcaaccgtcaaactccggttataaaagcgcccactttcggctgctgcaactgacccgccaacaattgccagatgatactgctgggcgagcgcactcaagaacgccttcgtccgcaacccatccggatccgccgtggtggccagatgttcgagatcatagccggtattccacatttccggcaatacaacgacctcagccccttgttgtgccgcttcagcaacggcagtggcaaccgtctgaaaattcttctccggttgaccaaatgcaatgtctatttgggctaatgcgattgttaattgcgccatttcaatccctcttttggttgattgcttcactaaaatgccgggacaatggagcccttaaatttcttagcgatgtaatctttaatcgtttgactttgataatattttttgatttgcttaatcactttgtcgttacgatgtttggtctggacaacaaaataatttggataagggttgttcgtcgtcttttcatggtaaattgcatcttgattgattgtgagaccggcatcaaatgcaaaattcgtattgattgcagcagcggccacatcctgtaagtgggtcggcaactgtgatgcttccagttcttcaattttcagccccaacggattggagacgacatcggccttagttgccttctgactgataccggccttgagcttaataacaccagcagcttcgaaaagttgcagcgctcgtaactcgttagacgggtcgtttggtaccgcaatcgaatcgccttttttgagtgccttcaaatccttaatcttcttggaataaacgcccatcggaaacgcaacggtcttgaaaacctgcgtaatcttaaagttcttggacttaatctgttcctttaaaaaaggtagggtctgatagctgtttgcgcctaaatcgccatcgtttaacgccacattcggactgttatagtcggtaaactgcttcaacttgatcgtcaaaccgtctttttgagccaattttgcgacctgtttcataatcagttcgtgcgggccggctgtgacacccaccgtaattgttttgtccgacaattgatcagtggcagacttgctgctagcttgacttgtgccacatgccgttagaatcaccacaagactgagcgcaacgaccgctgaaaaccctaacttcaaccatttcttcattaaaaatgcctccttgttgtcatgcgttttatatgcgcatgggtgtgtttgcgttactgataagagtgatggacgggatgagcgggttaagaaaacgaaaaagataacatggtcactagggtcggctggtgctcaagccataacgccttcctccctgcgcagaagtctgcgtgtaaggacctcagtcgtaatgaccaaacccgggtcatcacgactgaggccgcttacactccgacttctaagcgctcctgctcacgcttaacaaaaaagggccctgctgaatcaaaaaattgattcagcagggccgacagtgtcggggtaccaccctggttcgttaccgtgtaacctctacgatgcctgttgacaccgagaccgtttaacgcaggcctaatgcgtacccgactcatcgccgaatccattccgcggtcattttcatcagacgcctgcatcgatttccacctgccatcgactctctaaagctgcgttgctgattactctccacttcatgatgtttcatcattttatcagttatttttaaagttgaaagcagtttatctgcgtcgctgggaaatgtcaagcattttgttttttccgccatactttctttccttacgtcacgggatttgccaacttttaaaaattaaggttgacttcattgataacatcgcgtatgttaacaattatcacattaaatgagatttacatgagaggggttttgtcgatgaagctggatttagaattgcgtcccggcgctaatcggtttgtcagtgagacgggggcactcgcctacttggatacgatcttaaaggattttaccaaaccagtcgtcattactggcgagaaaagtttcgcggccttcaccaaagcttatcctggcaagttgaacttaccggtttatcattatgatggctctgccagtgacgagaacggtcatgccttggctgccgaaatcggtcaagccgatgccgtggtgggtattggtgccggccgcttgatcgacaccgcgaaagtcgcggctgaaactttgggggctgaactcgtcagcatccctaccctcgcctctaactgtgcacccttcacgcccttggccgccatttatcatgcgcagggccacaccttcagttacgtagaatattttaaaaagtcagcctacatcaccttggtcgattacaacctactgcttagcacaccgcacgactttttcgttgccgggattggcgacacgcttgccaagtggtacgaaatggacggcatcacccgccacaaagtcgatcaactgaatgcttacggtcaattgagtcgcgcctccgccaagaccattcaggcaattctgtttaaaaacgccgagcaagccttagctgatcttgatgccggtcgtgatacaccagcgtttgaagcagttgctgacaccatcatcggtcttgctggtgaagtcggtggctttggcggtattgacggccgtgctgcaggtgcccacgcgacgcataacggactttcatatttgccggaaacccacgctgttttacatggctccaaagtggcttatggtatcttggttcagctggccgaaaccggtgatgatgacgagatccgatcattattgcctttctatgaaaaaattggtctgccgacaaaccttgaagatttacacgttaccgaaaatgttgctgaaaaaatccttcaagtagccgaatttgcagccaagccagaagaaaccttcatcttggtcgacaaatctttgacgccgcaaaaagttgcggctgcaatggaaaaagtcgaagcagttacgagtgaagcggctgcataatcaaacgatatgttcaacaggttagttaatttgaaaagccttagtgaggaaatgctcactaaggcttttttaatcctccgtataacatctgcggctagatttgttttgttcgtttcactactgagagtctggctcaaagacctgaaatctcgaccgtacagtacatcatcacatgcttgaatttttccttaaattaacgtagagaaaactcgatttaacgtttatttgttccaaaaaatgacgattattccggaaaacccaacgttaaaatatttttgtcccgttaccgatctgttgttctatattaggcgtaaggaaaccggcgctttaatgacaagaaagcaacgtcatgtattgatcaacgagggaaacgtacatgaagaacgctactattgtgaaggcagccaaacgacaaaccattaaccacattggtgcgcaaaagtacctcaccggtgccagtgtcgcaggatcaggtgcaaaatccaaaaatccggaagttattgagagattggatcatttggatggtgtcggaggcgcagcttttgatgtttagcaaacctgtttttaagcttgtcttttgggtgattcttgccttggccaatattggtctcggaatgctgcttggtgcgacattgatgcaatctcttttaaatatattaacaatagtcccaataatttggatagttgttacaataatagaaatattgaccaagcgattcgcagacgaagaccagaaatcatgaataggataagcgaagggaacaaaatgaacttgaattgcagtatttggcaaacaattccaacttaaaaagaatcgcagcaaagtgcttcgattcttttttctagtccaaactaatctccttagcagctcgccgcataactttatcccgtattatctcataatgtcaaaggcatcagccgcttgcaactaattttttgccactactgtacggttttattttgatccaaataccccaatgtcgcagcagctacagccttggccgcgattagaatggcatcttcgtccagcataaagtcaggactgtggtggggatggtttgagccatcaggcagctgacagccgatgtagaagaagctgctcggaaccttctgcgcaaaataagcaaaatcttcagacggatcctggacgccggtatccttgatcgccgtgatttggggaatcttggctgctttgatcgctgccatggcctgattcgtcaacgtcgcatcattgatcaaaaccggataattgtcgtcataatccagcttggtttgtaccccaaacatggcttctaacccgtgattcatcgtcacaatttgctgatgaattatctgccgggtactttccttcatcacgcgcacgtcgccttttaacaccaccgcctgtttgatggcgttaaatgagccaaccccgtcaaacgaaccgatcgtgacgctggccgtatcaaaaggatcgattcgccgcgatacgatggtttggagcgccgtgaccaaataactgccagccacaatcgcatcgttgctcaaatgcggcatggaagcgtggccgcctttgccgataatcgtatcggtaaaattggcccggccagtttgggttgcgccggtatgatagccgatgagtcccgttggcattgacgacatcacatgaaccccgatgacattcgtaaccccctctaagaccccagctgcaatcatgccttttgccccaccaggcgatacttcttctgcaggttgatgaatgatccgaattgaacctgacagttgggttttaattttgttcaattccttggccaataccaataagtaagccgtgtgcgcatcatggccgcaagcgtgcatgaccccgggattttgcgatttaaacgggagctcattatcttcctgaatcgccaacgcatcaaagtccgcccgtaacgccaatttcggccccggctgcccgccttcaatatcgacgtacatgccataaccgtcaccacatggcacgactggcatatccaacgcagcgtaataggctttgatataagcagccgtttgtttctcgtgaaacgatacttccggatgtgcatgcagctgccggcgaatcgcaatcatttcctgttcatcgtcatccagcgcctgtaacaaggttgccaataaactcatgctgattttcccctccgtgattttgtctgaactttaggtaacttagcaatgaagcgaatcaaaaatgggcgcatggctttgaaaataacctccgccacgacaaacccgactgccaaggccatggcaatcaagatgacattataaatctgctgggctgcactcgcggcttttcccatggtaaaactacgcgcgcctagatacgcaatgccgcctgggacaagtgagactaagcttggtatgtaaatggtattgaccggcacccgatgacggatggcaaaataattacctaacaagccaatcaccacggttgcggtaaagttaggcaacactaggctatgatcctgaagactaatcagccaatacgcacaccacgacacgccacccgtaatgcctgccggtagcaatgcccgtttaggaatattggtgatcacgccaaaaccaatgcttgataaaacactcacgataaactcaaccagtaatcgcacgttaccgtccccctatgacttgggtcaacacaatggcaatgacaacgccagaaccaatcgccccggcaacaaaaaccgcatcaactgttcggacaatgccgctaataatctgacgcgacaagatttcccgaatcgcattggtaatcgccacccctggcaccaacggcatcaaggcactgataatgatgttccccgaactggcaccccagccaatattagccagcaactccgctaaaatagccaccacaaacgcacctgttgcttccttaaagtagggtgtcgtcgttttccgggcaaccaactcagccgcaagataaccaaagatcccgacaaaaaaagcccaggccaagtcgccattggtcgctttaaaaagcagcatcggcgccaccgacacccagccggcaccaagtatccgcgcccaccaaggaaaattaatcacttgccgctcaatccgggccacttcttgtttcagagcatcaaacgtaatctgatgagccacaaactcacgggaaagctgattcaattcatcgactttctgtaaattaaacccacccaaagaggatttgatcaatcgcgtgcggctttcattctccaaactgacaaaaacagctgtaatagttgcataacaagccaccttggcaccggcagcatggccaatatattcaaccgtcgtctcaatgcgggacgtctccgcgcccgcattgagcatgatctccccgaccttgccgcatacctctaagatttcctctgtatcaggctggctcatgatcccttgctccttaccgcgttatcgcatggcgttttactaattgtcggcttttttcgcgtcagtagcaagcaacccgccatgttttttattgaaacgtactaacaaagtcgaaaattagtttcattggtttctttcattaaccaatgaaaaaagtgcccgcctaagcaaacactttttctcagcatatgttatgttcatccaactaaggcgtattaactgcaaacaataaaatgcctaaaatgacataaaatgctgccagcatcagcacgacgatcaacagcgtcagcgcgcatttcaacaggagcgaaaactggcttttcttccaaatagcaaacagccagagtaccaacataacaaccatcagtagcatgagcccagacaacaagatccggggtaaaaaagcgatcatatcggtatacctcacaaatttgtgcctgcgattggtcgccattcatcgcgaatatcgctgaccgctctcaggataccaaggttttgcctctagcacaaaaaccctgcctcacaggttatcggcgacacacgaatgaagcttaccgcgggacgaagaagaacgcgattaaaagcagtgcgaccacgtaacatccctgagtaacaagcgcccctttgatccatcccttcatcggctgcaagttagctgcatgttgactggttaccaagagataaacaccgggtaaaatgccgaaaataggcacaaaagctaggatcaacaggaaaacaaaccacacggactggactagactttgcttcatcaaattggacaactccttttaattacgggcacgaacgacacttgaaaattgactaggtggtatagctaatactgcttccagcataatataaatttatttgttttcacagggcaacttctgctcgtttaatccctagttcagcaatttgttcgcggttcatcttgacaatctcaaaaaaaggggttgactggtaactaatatctttaggagtcgttttcgtccatatactgatacactcccttcgattttgcgactccgctttagcaacggtttttgatagcgtgcaaggagtaattaaaatgaatacatacagaaaaatcaatttgcgttgggtgtcgcatcaattacccgccttattaaaagtcaaacttgtttgtttcgcgcttgccagtgctttccagcaacttttgtcaggcttggttttgggccagcttgttgaacttgacttttcggataacctgaagctagctgaattcattttctttgctgttggttcctttgcgatcactgccgttgcagaatattactttgtcaaagccggacaacgagccattaggttacttaaccaagcactaaagaaggactattttgatgatgccctttcgaagtcactttccgagtcatctgaagtatccgacgtcattaaccgtgttgacggtgtagccaaacaagttgaacaaagctactttgagtcgttgctaacagtccttcaaagcagtattactttgattggatcagtgattgtcctactcaaactcaatttcgttttaagtttaatttatctactgttttcattaatatcgctattgcccagcgcttttggcagaaataaactgacgcgccaaaccgagaaatggacacatgccaatgctgatttgatgctcatcattaaggacttatttcgcggcagatttgacatcattaattttggggccggacccgccttttatgctcgctttaacaacaagcttaaccatgaagaagcagagtatgaacgaatgaatacgtatcagtactggattcaatttgtatcgtggtcgtttgccatttttgcctatttatcccctatctttattggcattatctttttaagaaatgggtggttcggtgtcactaaaggcattattgtgacgttaactttaaccgcagactccgtaatcagtggtattcgccaactcacgcagattcaaaccaagattgtcagcactgaaaagttacgacgcgtgcctattgtcaaaaatgtctttcttacgcctaacgccaaggaatctcagcccgccgccaaagaaccgaaaacattagcaattaataacttatcggttcagcgtgaccagcacgttatattcaaccatctaaacctaactctggctccaggtgaaaaaatcattgtaaccggtccctctggtattggtaagtcaacgctgttaaagaccattaccggacgaataaaaccgacaaacggctcgattcgcttccaggggcgcccgattactacaggtgattttgttctggtttcccaagacgtatggttgtttaatgcaactttgcgtgaaaatattacgttgtatcaaaattactcggatgaaacgcttcatcatattttaaatttagtcggcttaggtcgcgaactaggcaacaatgcgttggaaacacacatccgcgacaatggctccaatttatcaggcgggcaggcgcaaagaatcgcgattgctcgtggattattaagacaaagccccatcttcttattcgatgaaatctcggcaaacctagatgacgcgaatgcttataagatcagaaaattaatgtactcactcccttcaattgtcatcgaagtcgctcaccattatgatagcgcgttagccaaagaaaacgggattcacgtaaagaagaacttactgggtgcatcgcttactagctaatcgccatggtgttttgcataggtgtaacgaatctaccgggagcagctctgggttcaaaaaaaccgcgatcacactgaccgcggtttttttaatacaaatattcttagtaccttctccagcaacccgttactgtgccaccttactaattcgtccctgctcaatatacacggacaaaatagcgacatcagccggattaacgccactgattcggcttgcttgggcaatggtttccggttgaatcttaaccagcttttgccgtgcctcggttgctaagccattgattgcttcgtagttgatacgtgccggaatctttttgccttcaagccgcttcaacttggccacactggcttcttctttggcaatgtagccggcgtatttgatttggatctcaacctgttcaatcacccgatgatccaaggttgggttttccggtaagaactgttctagcgtctgataattgatttccggacgctttaagaagtcgctggctaagaccccatctttaagaggggcaaaatgatgagcttcaagccacgggttgacatccttgggcttcaggcgggtgtgctcaaggcgcgctaattcatcggtaatggcttgacgcttagccaaaaagtcagcatagcgttgatcactaatcaggccaagttcatgtcccattggcgttaagcgcagatccgcattgtcatgacgcagtaacaaccgatactcggcgcggctggttaacaaacgatacggttcattcgttccttttgtcacgagatcatctatcatcacgccaatataagcatctgaacgcttcaacgtgaagggacctttgccttgagcgcggcgggcagcattaatcccggccacaattccctgaccggctgcttcttcataaccactggtaccgttcatttgtccggcggtatacaaattctccacaaccttagtttccaacgttgctttcaactgccacggttcaatgacatcatactcgatggcataaccggcgcgcatgagttcggcatgctccaatcccgccacactatgcagcattttcaactggatttcttcgggcatggacgttgaaaagtcccccacataatattccgaggtgtcgcggccttcaggttccaagaataattgatgccgcggcttatcggcgaagcgaacaattttatcttcaatggatggacagtaacgcgggccaactcccttaatcacaccggaaaacatcggcgcgcgatccagattctcccgaataatctgatgggtcgtcgcgttggtgtaagtcatccaacaactcaactgatctttgagataaaccgaatccggcgttgtaaaactaaaatgattcggtgttttatcgcctggctgttcttcggttttggaaaagtcaatcgtattgccgttaacacgcggcggggttccggttttgaagcggcgcagtttaaagcccagctgctccaggttttcagaaagcttaatgcttggcagactgttattagggccggaactatacatgagttcgccgataataattttaccgcgggaactggtgccagccgttaacacaatacttttggcgcgataaatcgccccggtagccgccacgatgccgactgccttaccatcttcgaccagcacttcggtagcgagtccctgccgtaaatccaaatgcggcgtgtcttcaatgacgtgtttcatactgcggtgataagccgctttatccgcttgggcacgtaatgcgcgcactgccggacctttacccgtgttgagcatgcgcatctggatgtacgtccgatcaatattcttccccatttcaccgccgagggcatcaatttcacgaactacaattcctttggccggaccgcctaagctgggattacatggcataaatgccaacatttccaggctgattgtcagtaataatgtcttttcgcccatacgtgccgcagccaaggccgcttcacaaccagcgtgaccagcaccgacaacgatgacatcataagtgccggcttcaaatttctttacttcaggcatctgttttcctccaagcatctgtttttcacacgcccatgcgctacttacccagacagaactgactgaatagctgggtaattaattcatctggggcactttcgccagtaatttcgccaagcttgtcccaggccgcggtcatatcaatttgcactaaatcaatcggcatcccggcatgaatcccggccatgaccgcgtccaggcttttgctagcttgccgcaataggccgatttggcgcgcgttggagaccatgactgttccctgactattttcaatgccgccaaagaagagtttggcaattcgctcatccagtgcatccatgccatcactagttggaatggcggttttgatgatttcatcggcatcaaccaattgcagcaacgccgccgtgtctaaacgcgcaggcaaatcctgtttgttcaacacgatgatccgtttcttatcagccgttgccgcaagcagctgcttgtcttccgttgtcagcggctcgctttgatccaagaccagtaaaatcagatctgcctgcgtaattgcctgccgggaacgttccacgccgattttttcgactttatcggtggtgtcgtgaattccggctgtatcaacaagcttcaacggaaccccgcgaacattgacgtattcttcaaggacatcgcgcgtcgtaccggcaacgtccgtcacaatcgccttgtcttcgtgcaacatgtgattcagtaacgagctttttccaacatttggccggccgacaatggcagtggccaagccttcgcgcaacacttttccctgactggcggtagttaggagctgctcgatcgcctttttgacggtttgggccttttccaaaagcattttagttgtcatttcgtccgtatcgtactccggatagtcgatattaacttcgacttgagccaacacttcaagaatttcctgccgcagctgtttgattaaatggtgcaggttcccatcaagctgattgacggccacctgcatggcgcgatccgtttttgctcgaatcagatccatcaccgattccgcctcggtcaagtcaatgcggccgtttaaaaaggcgcgcttcgtgaattcccccggctcagccatacgcgccccttcgccaagcaataattgcagaatccgattggtcgccacgatcccgccatgacaattaatttccacaacatcttcacgcgtgaacgtctttggcgccagcataacgctgaccatgacttcatcaatcaaatcaccggtttcgggatcgacaatatgaccgtaatgaatggtatgacttttaacttgggtgagatctttgcctttaaaaaccttattggcagtggcaacagccgtttcgccacttaaacgaacaatactaatcgctccttcgccaggcggtgtcgagatggctgcaattgtgtcataagccgtaatagatgtcgccatatgcaaaaactccttttgatgatgtgagaatcgctgtgttggttggaaaatgagtggatgctttggtgtaagacgtttgaatcctacgctgggtcgcgctcgatcataacgcgctccctggcgcagaagtctgcgtgtaaggaccttggtcgcaatggccaagacccggccatcacgaccaaggccgcttacactccggtccctaaccgcgccgggtcgcgctcacaaaaaaagcgcagaacccagtctttccttatcgttgggaaaggctggataaagcactttgactacttcatcgtgattaaactgtgatcatcatacttaaatgttgcttacttgtcaaaagttagttacgggcgtttgggggtgacgacgacatagcgccggggatcgacgccttcggaatgggtgtcgacgtattgattgtccgccagtgttgtatggatcgccttgcgttcaaacgatggcattgggtctaagtaaatggctttgccggttgccagaacttcgcgcgcggttcgttcagctaagcgggtcacggttgcttggcggcgttcgcgatagtcgccgacgtccagcatgatggtccacttgcttttaccatagtggttaaactcggtttgcgctaagtattgaatcgcattgataatcttgccatgtttgccgattagcaagccttcctcattggttttgagttgaaaggtaacggtattaccttggcgctcgctgctgacttgggttttgatccccatgccgctagtaatatcttccaaataactttgcaccatggccagcgccgtttgattatcgcgctttttagtggtgatgtcgttaaatgcgctggcaatctttttaccggcgctatcggttaacgccaccgctagtttgctagcgcttgatttcccggtggcaggttctttcgctttaggatcaggcgcgggatctgccggtggttcgagtggtttcaagttaacaatcgctggcttgcgcatgaatccaaggaagccattcttattttcctgaaccacttggacactcacggcatcacgcggtaagccaagttgtttgagtccggcctcgatggctctttgaatcgtactgccttgaaaggttggcatcttgcttcctcccgttgttatttacgccgtttggtcgcttttttatacgcttttctaagtgcgcgttctttttccttctcggcccgtgctttttcttcacgttcacgccgaatcttaaacggattttgaatcaacaattgctgaaccattgaaaaggcgttggtaacaacccagtaaatggccagcgcacttggcaacgtaacggagaatacaaaaatcatagccggtgaaatgatcatcatcacccagctgcttgaattgcgggtcggttgggccatcatcgataaaatactggttcccaaagtaaataaggttgccagaatctgcataatccacaatgggtcaggttgtgacaggttcatccatagaaaagtcccggattgcaatgaagaagttcgtaaaatcgcttgatatagtgcgatcaggaacggcatctggatcacaatcggcaaacagcccatcaccgggttaacgccagctgacgcataaagcttttgcgtctcgtcgcggagtttggtttgggtttcggtgtcttttgaactgtattttttctgtagttcttttaactgcggggcgatttcctgctgcttggccatgctcttgatggacagatagctcaacgggaaaatcaaaatccggataattaaggtaaaggcgatgatcccgacaccaggattcccaccaaacaaattggccagccagataacaaattgaccggcagtataaaccacatagcgatcccagaatccggtactgttttctgacaccggtgccgttccacaggcagtcagaagaaagaccagactcagcatgctcacaatgacgagcaggcgtttgaattgacgatttttcacaaataatccctctcttaatctcaacatggtcaaatgacctcgatatcttcgttcaggatgcccgccaaccgcatgacatgtatcaggttcttctttgtctcagccatatcaagctgattagcggacttacgcgcgataaccaaaaaatcagtctggggatcaatctcaggctttagctccaacagactctggcgaatatagcgttttatctgattacgcatgacggcagtgtggccgacttttttgcctacagagatgcccacccgaaaatgcggttgatcgcgtttcatgtgatagatcacaaaattacgattggcaaccgaatcaccatggtcaaacacattttgaaattcaacttcttttttgatccgatatgacttgcgcaatgatgctccctcacaatctggttctaagtatacaagatgacaagatgttttcctatatgtatcagcggctaacgacaggtttcttttcagcccgctaaacagcctcataaacgcaaatgaacgacaacgaccaacaatcgggtcattgccgttcattggttgtgacgtgtcagcgcatgggttaaccgcggtgccgggtcattcatgaaaaaatgcgggcaagcgttttcggtgactgcctttgctgtgctaattagtcgcttggtgatggtgcgagtggttcaagaacgtaccgattgattgcagaagatgcgcgctcttagcagggctgccttttgcaactgttgacggctccgaaacgcgctctccagcgcagaaacctgcgtataaggacctctgaaccccaatggccaaaacccggccgaccaattacggctccgaaacgcgctctccagcgcagaaacctgcgtataaggacctcagaccccaatggccaaaacccagccattggggtctgaggccacttatactccggtttctaaccgcgctggttcgcgctctgctctaaaaaaaaccactgacgcggtcagtggcttaggcagataatactttacgtcctttagcgcgacggcgtgctaaaactttgcggccgttctttgtgctcatccgcttcatgaaaccatgaacacgttcgcggtgacgtttctttggttggaaagtccgcttggttgtcattgacgacacctcctagttaaaaccgatttatcttattaagatgacttgcattatcagacatcatccgagtttacacgaggaagcaagccgcgtcaaggctttttcactgacatcgtacatctttgtcgatcgcaagcgatattgtcttaagtaagcagttagccaaagtgtcacaaaatctgtaacctcttagaagaatacatctaggaggaatcacatgaagaaggttgtcttaacgatgagagaagaagaacgttaccgagttatcaaagcagtggttaatggtaaaacctcaattcaacgcgcagcagtcaggctcaaacgttcagagcgaaccatttaccgtttaatccaactatacaagcatcagggcaaagacggttttatccatggcaacgctggtcgtgagcctgccaacaaacgcaatgcgcaacttgagcgccaaatcattcatctgtacacaaataaatatgccgggttcaacatcgcccatttccatgaatttttaaccaccgacgagcaaatcactatctccgaatcttcactccgactcttattcagaaaaaaacagattctttctcctaaagcgcacaaggccaccaagcgtcgtgtcaaacgcgagctaaaagccaaagagaaaaaggtggagctactttcgaaacgtgacgaagctaccctgtcagctatcgaagccgttgaaaacatcaaagcccacccagaacgtcctcggaaacgttacgctggcgaactggttcaaatggacgcttcatgtgaacactggtttggcactcaaaaagccaccttacacgccgctattgatgatcaatccggaaatgttgtcggcggctactttgcccaacaagagaccctgagcggttactatcatgtttttgcccaaatccttcgcaattatggcgctccagctgaatttctaactgaccggcgaaccgtgtttaacagcaataaaaaagagggctcaccttcgaccgagaaccctctcacacgcttcggttatgcctgccaaacgcttggaacagaacttttggtcaccagtgttccacaaggtaaaggccgtatagaacggcttctggagacttttcaagatcggctcacaagtgaactaaggctgcataacgtcaacacaatcgcagatgccaatcggtttttggtcggctttattaagcgccacaacaaccgtttcgcatcgcccattaaaagtaacatgtcagtatttgagaagcaactaaccccaaaggaaattgacaatatcttgattattgccaatgaacgcagcatcggccatggccactgcatccgctttgaaaacaagcgctatctgccacatcgaaatggcgagcttatctatttaccgccacacaccaaagtactagtcatcaagagctttactggcaagctttatatgacgacagacgacgatcaggtttatgacctcttttgcgtgccaagggagtatgccttctccgctaaattcgatctaacaccgcctgaacccgccacccctaaaaaagctaggaaagtccccgctataacgcatccatggcgtcgagcaaactatcgagattatcttgattctctaggcctcgacagcgaacaaatcaaatggctggttaatgatcgttatccagttcgaaattcacaaacaagccacgtctaatcaggatcatttcgcgtccaattttcggacgcatgttttatggaatttactgtcaaagtcgaaaatcgcttgacaggctttttcactgacatcgtacatctttttaggatttgaactgggtcagttgcagcaatcgggtttgtggataacttgtgtgttgttaaaatacaaagcttatttcatgcacaggctgcgcacaagtaatttgcaagttcacatccatgtttatagagttatccacaggctgtaaatcgcctgttcatatcttgtgaaacacttacggctacaaggttttggttccacagacaaattgtgtataacttgcaatttggggattttggctttaatcatcctcagccttggggataatttgttcgcaccctgtttctttttcacttttttgtttgtggaaaactgtgatttctgtggaaaactcctttctgcaatgctaaacttatttttgcagaacatttttggccctaaccgaaaatccatgatctagctaagctgattcgcctaaatgatgccgttatctcgcttattgcggcgtttgggtaactgattggctttacctaaatcgaaactagtgtacacttatccacctgtcgacaacttttgcggttgccttggctttttgtgcgctaatcattatgtttgactaccatcaatgttggctatcggttttgggacgccgatgccaaccgttattagaggaggggcgtttatgcccaatttagaggagctttgggcttac
